US012617815B2

(12) United States Patent
Schellenberger et al.

(10) Patent No.: US 12,617,815 B2
(45) Date of Patent: May 5, 2026

(54) BARCODED XTEN POLYPEPTIDES AND COMPOSITIONS THEREOF, AND METHODS FOR MAKING AND USING THE SAME

(71) Applicant: AMUNIX PHARMACEUTICALS, INC., South San Francisco, CA (US)

(72) Inventors: Volker Schellenberger, Palo Alto, CA (US); Eric Johansen, Oakland, CA (US); Angela Henkensiefken, San Jose, CA (US)

(73) Assignee: Amunix Pharmaceuticals, Inc., South San Francisco, CA (US)

( * ) Notice: Subject to any disclaimer, the term of this patent is extended or adjusted under 35 U.S.C. 154(b) by 816 days.

(21) Appl. No.: 17/776,478

(22) PCT Filed: Nov. 13, 2020

(86) PCT No.: PCT/US2020/060378
§ 371 (c)(1),
(2) Date: May 12, 2022

(87) PCT Pub. No.: WO2021/097186
PCT Pub. Date: May 20, 2021

(65) Prior Publication Data

US 2023/0287040 A1 Sep. 14, 2023

Related U.S. Application Data

(60) Provisional application No. 62/934,980, filed on Nov. 13, 2019.

(51) Int. Cl.

| | |
|---|---|
| ***C07K 1/13*** | (2006.01) |
| ***C07K 14/00*** | (2006.01) |
| ***C12N 15/70*** | (2006.01) |
| ***G01N 33/68*** | (2006.01) |

(52) U.S. Cl.
CPC .............. *C07K 1/13* (2013.01); *C07K 14/001* (2013.01); *C12N 15/70* (2013.01); *G01N 33/6848* (2013.01); *C12N 2800/101* (2013.01); *G01N 2333/95* (2013.01)

(58) Field of Classification Search
None
See application file for complete search history.

(56) References Cited

U.S. PATENT DOCUMENTS

| | | | |
|---|---|---|---|
| 4,816,567 | A | 3/1989 | Schmuel et al. |
| 4,826,763 | A | 5/1989 | Kjeld et al. |
| 5,075,222 | A | 12/1991 | Hannum et al. |
| 5,114,923 | A | 5/1992 | Seilhamer et al. |
| 5,118,666 | A | 6/1992 | Habener |
| 5,175,146 | A | 12/1992 | Basava et al. |
| 5,234,906 | A | 8/1993 | Young et al. |
| 5,324,639 | A | 6/1994 | Brierley et al. |
| 5,364,840 | A | 11/1994 | Basava et al. |
| 5,364,934 | A | 11/1994 | Drayna et al. |
| 5,374,618 | A | 12/1994 | Craig et al. |
| 5,424,286 | A | 6/1995 | Eng |
| 5,521,283 | A | 5/1996 | Dimarchi et al. |
| 5,532,336 | A | 7/1996 | Dimarchi et al. |
| 5,534,617 | A | 7/1996 | Cunningham et al. |
| 5,574,010 | A | 11/1996 | McFadden |
| 5,604,203 | A | 2/1997 | Balasubramaniam et al. |
| 5,631,230 | A | 5/1997 | Fang et al. |
| 5,674,710 | A | 10/1997 | Seilhamer et al. |
| 5,686,411 | A | 11/1997 | Gaeta et al. |
| 5,821,337 | A | 10/1998 | Carter et al. |
| 5,843,446 | A | 12/1998 | Ladd et al. |
| 5,885,573 | A | 3/1999 | Bluestone et al. |
| 5,948,761 | A | 9/1999 | Seilhamer et al. |
| 6,214,797 | B1 | 4/2001 | Vale et al. |
| 6,320,022 | B1 | 11/2001 | Cuttitta et al. |
| 6,406,632 | B1 | 6/2002 | Safir et al. |
| 6,491,916 | B1 | 12/2002 | Bluestone et al. |
| 6,716,626 | B1 | 4/2004 | Itoh et al. |
| 6,806,063 | B2 | 10/2004 | Pedersen et al. |

(Continued)

FOREIGN PATENT DOCUMENTS

| | | | |
|---|---|---|---|
| EP | 4058466 | A1 | 9/2022 |
| WO | WO 1987/001728 | A1 | 3/1987 |

(Continued)

OTHER PUBLICATIONS

Balzar et al, "The biology of the 17-1A antigen (Ep-CAM)", Journal of Molecular Medicine, Oct. 1999, vol. 77, No. 10, pp. 699-712.
Banner et al., "Crystal structure of the soluble human 55 kd TNF receptor-human TNFβ complex: Implications for TNF receptor activation", Cell, May 7, 1993, 73(3): 431.
Becker et al. "Clinical Review 167: Procalcitonin and the Calcitonin Gene Family of Peptides in Inflammation, Infection, and Sepsis: A Journey from Calcitonin Back to Its Precursors", JCEM, Apr. 2004, vol. 89, No. 4, pp. 1512-1525.
Bell, "Isolation of the human insulin-like growth factor genes: Insulin-like growth factor II and insulin genes are contiguous", Proc Natl Acad Sci USA., Oct. 1985, vol. 82, pp. 6450-6454.
Buchanan et al., "Engineering a therapeutic IgG molecule to address cysteinylation, aggregation and enhance thermal stability and expression", mAbs, Mar. 1, 2013, Landes Bioscience, vol. 5, Nr: 2, pp. 255-262.

(Continued)

*Primary Examiner* — Kaijiang Zhang
(74) *Attorney, Agent, or Firm* — Sheppard Mullin Richter & Hampton LLP

(57) ABSTRACT

Disclosed herein are polypeptides comprising an extended recombinant polypeptide (XTEN) comprised of a plurality of overlapping sequence motifs and one or more barcode fragments releasable upon protease digestion and detectable from ail other proteolytic-ally releasable fragments. Certain embodiments of these polypeptides further comprise a biologically active polypeptide, wherein advantageous embodiments thereof comprise a releasable segment capable of proteolytic cleavage that cleaves the linkage between the XTEN polypeptide and the biologically active polypeptide. Methods of making and methods of using said polypeptides are also disclosed.

12 Claims, 7 Drawing Sheets

Specification includes a Sequence Listing.

(56) References Cited

U.S. PATENT DOCUMENTS

| | | | |
|---|---|---|---|
| 6,858,409 | B1 | 2/2005 | Thompson et al. |
| 6,965,013 | B2 | 11/2005 | Hsu |
| 6,967,237 | B2 | 11/2005 | Bednarek |
| 7,112,659 | B2 | 9/2006 | Mann et al. |
| 7,166,575 | B2 | 1/2007 | Quay |
| 7,271,238 | B2 | 9/2007 | Gaeta et al. |
| 7,294,513 | B2 | 11/2007 | Wyatt |
| 7,385,026 | B1 | 6/2008 | Kangawa et al. |
| 8,044,175 | B2 | 10/2011 | Dransfield et al. |
| 8,067,532 | B2 | 11/2011 | Maclean |
| 2001/0027181 | A1 | 10/2001 | Kitakaze et al. |
| 2002/0042367 | A1 | 4/2002 | Stewart et al. |
| 2002/0119490 | A1 | 8/2002 | Martinez-Martin et al. |
| 2003/0228309 | A1 | 12/2003 | Salcedo et al. |
| 2008/0261886 | A1 | 10/2008 | Hedner |
| 2010/0239554 | A1 | 9/2010 | Schellenberger et al. |
| 2010/0323956 | A1 | 12/2010 | Schellenberger et al. |
| 2011/0046060 | A1 | 2/2011 | Schellenberger et al. |
| 2011/0046061 | A1 | 2/2011 | Schellenberger et al. |
| 2011/0077199 | A1 | 3/2011 | Schellenberger et al. |
| 2011/0172146 | A1 | 7/2011 | Schellenberger et al. |
| 2012/0034228 | A1 | 2/2012 | Kufer et al. |
| 2018/0030531 | A1 | 2/2018 | de Raad et al. |
| 2019/0024145 | A1 | 1/2019 | Vigneault et al. |

FOREIGN PATENT DOCUMENTS

| | | | | |
|---|---|---|---|---|
| WO | WO 1996/022308 | A2 | 7/1996 | |
| WO | WO 1998/052976 | A1 | 11/1998 | |
| WO | WO 2000/003317 | A1 | 1/2000 | |
| WO | WO 2000/057183 | A1 | 9/2000 | |
| WO | WO 2002/079232 | A2 | 10/2002 | |
| WO | WO 2005/118635 | A2 | 12/2005 | |
| WO | WO 2007/033230 | A2 | 3/2007 | |
| WO | WO 2010/091122 | A1 | 8/2010 | |
| WO | WO 2010/144502 | A2 | 12/2010 | |
| WO | WO 2010/144508 | A1 | 12/2010 | |
| WO | WO 2011/028228 | A1 | 3/2011 | |
| WO | WO 2011/028229 | A1 | 3/2011 | |
| WO | WO 2011/028344 | A2 | 3/2011 | |
| WO | WO 2014/011819 | A2 | 1/2014 | |
| WO | WO 2015/023891 | A2 | 2/2015 | |
| WO | WO 2016/077505 | A2 | 5/2016 | |
| WO | WO-2016145416 | A2 * | 9/2016 | ........... C12Q 1/6809 |
| WO | 2019074841 | A1 | 4/2019 | |
| WO | WO 2019/126576 | A1 | 6/2019 | |
| WO | WO 2021/097186 | A1 | 5/2021 | |

OTHER PUBLICATIONS

Burgess et al., "The heparin-binding (fibroblast) growth factor family of proteins", Ann. Rev. Biochem., 1989, vol. 58, pp. 575-606.
Caliceti et al., "Pharmacokinetic and Biodistribution Properties of Poly(ethylene glycol)-Protein Conjugates", Advanced Drug Delivery Reviews, Sep. 26, 2003, vol. 55, pp. 1261-1277.
Chatenoud, "CD3-specific antibody-induced active tolerance: from bench to bedside", Nat. Rev. Immunol., Feb. 1, 2003, vol. 3, pp. 123-132.
Chen et al., Influence of Histidine on the Stability and Physical Properties of a Fully Human Antibody in Aqueous and Solid Forms, Pharmaceutical Research, 2003, vol. 20, pp. 1952-1960.
Chou et al., "Prediction of protein conformation", Jan. 15, 1974, Biochemistry, vol. 13, Iss. 2, pp. 222-245.
Couder et al., Int. J. Peptide Protein Res., (19930000), vol. 41, pp. 181-184.
Coulier et al., "The human and mouse fibroblast growth factor 6 (FGF6) genes and their products: possible implication in muscle development". Prog. Growth Factor Res., 1994, vol. 5, p. 1.
Fu et al., Endocrinology, 2004, vol. 145, pp. 2504-2603.
Garnier et al., "GOR method for predicting protein secondary structure from amino acid sequence", Methods Enzymol, 1996, vol. 266, pp. 540-553.
Gastl, "Ep-CAM overexperssion in breast cancer as a predictor of survival", Lancet, Dec. 9, 2000, vol. 356, Issue 9246, pp. 1981-1982.
George et al., "An analysis of protein domain linkers: their classification and role in protein folding", Protein Engineering, 2003, vol. 15, No. 11, pp. 871-879.
Ghirlando et al., "Glycosylation of human IgG-Fc: influences on structure revealed by differential scanning micro-calorimetry", Immunology Letters, May 3, 1999, vol. 68, issue 1, pp. 47-52.
Herold et al., "Anti-CD3 monoclonal antibody in new-onset type1 diabetes mellitus", New England Journal of Medicine, May 1, 2002, vol. 346, pp. 1692-1698.
International Search Report and Written Opinion for PCT International Patent Application No. PCT/2020/060378, mailed Mar. 1, 2021.
Ishimitsu et al., "Genomic Structure of Human Adrenomedullin Gene", Biochem. Biophys. Res. Commun, Aug. 30, 1994, vol. 203, Issue1, pp. 631-639.
Kangawa et al., "Identification in Rat Atrial Tissue of Multiple Forms of Natriuretic Polypeptides of About 3,000 Daltons", BBRC, Jun. 15, 1984, vol. 121, issue 2, p. 585.
Kangawa et al., "Purification and Complete Amino Acid Sequence of α-human Atrial Natriuretic Polypeptide (α-hANP)", Biochemical and Biophysical Research Communications, Jan. 13, 1984, vol. 118, No. 1, pp. 131-139.
Koda, "Amylin concentrations and glucose control", Lancet, May 9, 1992, vol. 339, issue 8802, pp. 1179-1180.
Köhler et al., "Continuous cultures of fused cells secreting antibody of predefined specificity", Nature, Aug. 1, 1975, vol. 256, p. 495.
Kojima et al., "Ghrelin is a growth-hormone-releasing acylated peptide from stomach", Nature, Dec. 9, 1999, vol. 402, pp. 656-660.
Kumar et al., ATGAM versus OKT3 induction therapy in cadaveric kidney transplantation: patient and graft survival, CD3 subset, infection, and cost analysis, Transplant. Proc., 1998, vol. 30, issue 4, pp. 1351-1352.
Marins et al., "A growth hormone-based phylogenetic analysis of euteleostean fishes including a representative species of the Atheriniformes Order, Odontesthes argentinensis", Genetics and Molecular Biology, 2003, vol. 26, No. 3, pp. 295-300.
Martin et al., "Expression of the 17-1A antigen in gastric and gastro-esophageal junction adenocarcinomas: a potential immunotherapeutic target?", J Clin Pathol, 1999, vol. 52, pp. 701-704.
Miyamoto et al., "Peptide barcoding for establishment of new types of genotype-phenotype linkages", Publication data: PLOS One, Apr. 23, 2019, Public Library of Science, vol. 14, No. 4, pp. e0215993.
Murray et al., "Epitope Affinity Chromatography and Biophysical Studies of Monoclonal Antibodies and Recombinant Antibody Fragments", Journal of Chromatography Science, 2002, vol. 40, pp. 343-349.
Packeisen et al., "Detection of Surface Antigen 17-1A in Breast and Colorectal Cancer", Apr. 25, 1999, vol. 18, Nr: 1, pp. 37-40.
Passlick et al., "The 17-1A antigen is expressed on primary, metastatic and disseminated non-small cell lung carcinoma cells", International Journal of Cancer, Aug. 15, 2000, vol. 87, No. 4, pp. 548-552.
Rafaeloff et al., "Cloning and sequencing of the pancreatic islet neogenesis associated protein (INGAP) gene and its expression in islet neogenesis in hamsters", J Clin Invest, May 1, 1997, vol. 99, No. 9, pp. 2100-2109.
Rawlings et al., "MEROPS: the peptidase database", Nucleic Acids Res., 2008, vol. 36, Database issue, p. D320.
Sgro, "Side-effects of a monoclonal antibody, muromonab CD3/orthoclone OKT3: bibliographic review", Toxicology, Dec. 20, 1995, vol. 105, Issue 1, pp. 23-29.
Shalaby et al., "Development of humanized bispecific antibodies reactive with cytotoxic lymphocytes and tumor cells overexpressing the HER2 protooncogene", J. Exp. Med., Jan. 1, 1992, vol. 175, Issue 1, pp. 217-225.
Smith et al., "Nonmitogenic anti-CD3 monoclonal antibodies deliver a partial T cell receptor signal and induce clonal anergy", Publication data: Journal of Experimental Medicine,,Apr. 21, 1997, vol. 185, No. 8, pp. 1413-1422.

(56) References Cited

OTHER PUBLICATIONS

Stickler et al., "Human population-based identification of CD4(+) T-cell peptide epitope determinants", J Immunol Methods, 2003, vol. 281, pp. 95-108.
Sturniolo, T. et al., "Generation of tissue-specific and promiscuous HLA ligand databases using DNA microarrays and virtual HLA class II matrices", Nat Biotechnol, Jun. 1999, vol. 17, pp. 555-561.
Sudoh et al., "Cloning and sequence analysis of cDNA encoding a precursor for human brain natriuretic peptide", BBRC,, Mar. 31, 1989, vol. 159, issue 3, p. 14207-1434.
Tunnacliffe, "The majority of human CD3 epitopes are conferred by the epsilon chain", International Immunology, Nov. 1989, vol. 1, issue 5, pp. 546-550.
Van Zoelen et al., "The use of nonhomologous Scratchard analysis in the evaluation of ligand-protein interactions", Trends Pharmacol Sciences, Dec. 1, 1998, vol. 19, No. 12, p. 487-490.
Wong, "The mechanism of anti-CD3 monoclonal antibodies. Mediation of cytolysis by inter-T cell bridging", Transplantation, Oct. 1990, vol. 50, pp. 683-689.
Egloff, et al. Engineered peptide barcodes for in-depth analyses of binding protein libraries. Nature Methods. Apr. 22, 2019; 16(5):421-428. with Supplementary information.

* cited by examiner

| | NT | A | B | C | D | CT | X |
|---|---|---|---|---|---|---|---|
| Limited Truncation | 0.80 | 1.00 | 0.98 | 0.99 | 1.00 | 1.00 | 0.99 |
| Severe Truncation | 0.80 | 0.97 | 0.95 | 0.97 | 1.00 | 1.00 | 0.87 |

BARCODED XTEN POLYPEPTIDES AND COMPOSITIONS THEREOF, AND METHODS FOR MAKING AND USING THE SAME

RELATED APPLICATIONS

This application is a 35 U.S.C. § 371 filing of International Patent Application No. PCT/US2020/060378, filed Nov. 13, 2020, which claims priority to U.S. Provisional Patent Application Ser. No. 62/934,980, the entire disclosures of which are hereby incorporated herein by reference.

SEQUENCE LISTING

The instant application contains a Sequence Listing which has been submitted electronically in ASCII format and is hereby incorporated by reference in its entirety. Said ASCII copy, created on Nov. 6, 2020, is named 20-1761-WO_Sequence_Listing_ST25.txt and is 1494 bytes in size.

BACKGROUND

A polypeptide can be produced in a manner that results in a mixture of polypeptides. The mixture of polypeptides can often include the full-length polypeptide, along with size variants (e.g., truncations) thereof. The presence of variants that differ in size from the desired full-length product can affect the biological behavior of a polypeptide drug substance, potentially affecting the safety and/or efficacy of the polypeptide drug substance. For example, protein-based prodrugs for cancer therapy can be engineered with a tumor-targeted activation mechanism. More specifically, the full-length therapeutic protein can be produced and administered in an inactive (non-cytotoxic) prodrug form, that is converted to the active drug by preferential removal of a portion of the prodrug polypeptide at the intended biological side (e.g., the tumor). Truncation variants of the full-length construct can lose protective sequences and become cytotoxic (active), thus “contaminating” the prodrug composition and producing a mixture having components that are unintentionally active outside the intended biological site. In some instances, such shorter length variants can pose a greater risk of immunogenicity, have less selective toxicity for tumor cells, or show a less desired pharmacokinetic profile (e.g., resulting in a narrowed therapeutic window) compared with the full-length protein, or deleteriously have unintended effects in a recipient outside the intended site (e.g. in healthy tissue). As a result, detection and quantification of protein structural variations can be important for assessing biological properties (e.g., clinical safety and pharmacologic efficacy) of biotherapeutics and in developing new biotherapeutics (e.g., with increased efficacy and reduced side effects). Existing techniques and methods for identifying and quantifying the amount of “contaminating” truncation products can include one or more drawbacks, such as being of limited sensitivity, ease, efficiency, or effectiveness.

SUMMARY

Disclosed herein are polypeptides comprising an extended recombinant polypeptide (XTEN) that is comprised of a plurality of non-overlapping sequence motifs. In XTEN polypeptides of this invention, the plurality of non-overlapping sequence motifs comprise: a set of non-overlapping sequence motifs, wherein each of said sequence motifs is repeated at least twice in the XTEN polypeptide; and also a unique non-overlapping sequence motif that occurs only once within the XTEN polypeptide; wherein the polypeptide further comprises a first barcode fragment releasable from the polypeptide upon digestion by a protease. In said embodiments, the first barcode fragment is a portion of the XTEN that includes at least part of the sequence motif that occurs only once within the XTEN and differs in sequence and molecular weight from all other peptides fragments that are releasable from the polypeptide upon complete digestion of the polypeptide by the protease. Further, in XTEN embodiments of the invention provided herein, the barcode fragment does not include the N-terminal amino acid or the C-terminal amino acid of the polypeptide. As further disclosed herein, XTEN polypeptides of this invention are characterized as comprising at least 150 amino acids, more specifically 150-3000 amino acids in length. The amino acids comprising XTEN polypeptides of the invention are characterized wherein at least 90% of these residues are glycine (G), alanine (A), serine (S), threonine (T), glutamate (E), or proline (P), and the XTEN polypeptide comprises at least four of these amino acids (G, A, S, T, E, or P). In addition, XTEN polypeptides as provided herein comprise nonoverlapping sequence motifs that are 9 to 14 amino acid sequences in length and within each of said nonoverlapping motifs the sequence of G, A, S, T, E, or P amino acids is substantially randomized with respect to any other nonoverlapping sequence motif comprising the XTEN polypeptide.

In some embodiments, the barcode fragment does not include a glutamic acid that is immediately adjacent to another glutamic acid in the XTEN. In some embodiments, the barcode fragment has a glutamic acid at its C-terminus. In some embodiments, the barcode fragment has an N-terminal amino acid that is immediately preceded by a glutamic acid residue. In some embodiments, the glutamic acid residue that precedes the N-terminal amino acid is not immediately adjacent to another glutamic acid residue. In some embodiments, the barcode fragment does not include a glutamic acid residue at a position other than the C-terminus of the barcode fragment unless the glutamic acid is immediately followed by a proline. In some embodiments, the barcode fragment is located from 10 amino acids to 150 amino acids from either the N-terminus of the polypeptide or the C-terminus of the polypeptide.

In some embodiments, the sequence motifs of the set of non-overlapping sequence motifs are identified herein by SEQ ID NOs: 182-203 and 1715-1722. In some embodiments, the sequence motifs of the set of non-overlapping sequence motifs are identified herein by SEQ ID NOs: 186-189. In some embodiments, the set of non-overlapping sequence motifs comprise at least two, at least three, or all four of the sequence motifs SEQ ID NOs: 186-189.

In specific embodiments, polypeptides provided herein comprise an XTEN polypeptide as disclosed herein wherein the barcode fragment does not include the N-terminal amino acid or the C-terminal amino acid of the polypeptide; does not include a glutamic acid that is immediately adjacent to another glutamic acid in the XTEN; has a glutamic acid at its C-terminus; has an N-terminal amino acid that is immediately preceded by a glutamic acid residue; and is located 10 amino acids to 125 amino acids from either the N-terminus of the polypeptide or the C-terminus of the polypeptide.

In some of these specific embodiments, the glutamic acid residue that precedes the N-terminal amino acid is not immediately adjacent to another glutamic acid residue. In some of these specific embodiments, the barcode fragment does not include a glutamic acid residue at a position other than the C-terminus of the barcode fragment unless the glutamic acid is immediately followed by a proline.

In some embodiments, the XTEN polypeptides provided herein comprise a plurality of non-overlapping sequence motifs, wherein each said sequence motif is repeated at least twice in the XTEN polypeptide and is between 9 and 14 amino acids in length. In some embodiments, the sequence motifs of the set of non-overlapping sequence motifs are identified herein by SEQ ID NOs: 182-203 and 1715-1722. In some embodiments, the sequence motifs of the set of non-overlapping sequence motifs are identified herein by SEQ ID NOs: 186-189. In some embodiments, the set of non-overlapping sequence motifs comprises at least two, at least three, or all four of the sequence motifs SEQ ID NOs: 186-189. In some embodiments, at least 91%, 92%, 93%, 94%, 95%, 96%, 97%, 98%, 99% or 100% of the amino acid residues of the XTEN polypeptide are a combination of glycine (G), alanine (A), serine (S), threonine (T), glutamate (E) or proline (P), wherein the XTEN polypeptide comprises at least four of these amino acids (G, A, S, T, E, or P). In some embodiments, the XTEN is from 150 to 3000 amino acids in length. In some embodiments, the XTEN is from 150 to 1000 amino acids in length. In some embodiments, the polypeptide can be cleaved by a protease that cleaves on the C-terminal side of glutamic acid residues that are not followed by proline. In certain embodiments, the protease is a Glu-C protease.

In some embodiments of the XTEN polypeptides provided herein, the barcode fragment is located within 200, within 150, within 100, or within 50 amino acids of the N-terminus of the polypeptide. In some embodiments, the barcode fragment is located between 10 and 200, between 30 and 200, between 40 and 150, or between 50 and 100 amino acids from the N-terminus of the protein. In some embodiments, the barcode fragment is located within 200, within 150, within 100, or within 50 amino acids of the C-terminus of the polypeptide. In some embodiments, the barcode fragment is located between 10 and 200, between 30 and 200, between 40 and 150, or between 50 and 100 amino acids from the C-terminus of the protein. In some embodiments, the barcode fragment is at least 4 amino acids in length. In some embodiments, the barcode fragment is between 4 and 20, between 5 and 15, between 6 and 12, or between 7 and 10 amino acids in length. In some embodiments, the barcode fragment is identified herein by SEQ ID Nos: 8020-8030 (BAR001-BAR011).

In some embodiments, the polypeptide further comprises a second barcode fragment wherein the second barcode fragment is a portion of the XTEN and differs in sequence and molecular weight from all other peptides fragments that are releasable from the polypeptide upon complete digestion of the polypeptide by protease. In some embodiments, the polypeptide further comprises a third barcode fragment wherein the third barcode fragment is a portion of the XTEN and differs in sequence and molecular weight from all other peptides fragments that are releasable from the polypeptide upon complete digestion of the polypeptide by protease.

In some embodiments, the XTEN has at least 90%, at least 92%, at least 95%, at least 98%, at least 99% or 100% sequence identity to a sequence identified herein by SEQ ID NOs: 8001-8019. In some embodiments, the XTEN is at least 200, at least 250, at least 300, at least 350, at least 400, at least 450, or at least 500 amino acids in length.

In some embodiments, the polypeptide further comprises a biologically active polypeptide linked to the XTEN polypeptide (BPXTEN). In some embodiments, the XTEN polypeptide is linked to the biologically active polypeptide at the XTEN's amino or carboxyl terminus. In either configuration, the barcode fragment is located within a region of the XTEN that extends, as measured from the amino or carboxyl terminus linked to the biologically active polypeptide, between 5% and 50%, between 7% and 40%, or between 10% and 30% of the length of the XTEN.

In some embodiments, the BPXTEN polypeptide further comprises one or more reference fragments releasable from the polypeptide upon digestion by the protease, wherein the one or more reference fragments each comprise a portion of the biologically active polypeptide. In some embodiments, the one or more reference fragments is a single reference fragment that differs in sequence and molecular weight from all other peptide fragments that are releasable from the polypeptide upon digestion of the polypeptide by the protease. In some embodiments, said reference fragment comprises a peptide whose presence in a polypeptide mixture indicates its existence or integrity (i.e., that the protein has not been degraded or proteolytically cleaved).

In some embodiments, the BPXTEN polypeptide further comprises a first release segment (RS1) located between the XTEN and the biologically active polypeptide. In some embodiments, the RS1 comprises an amino acid sequence having at least 90%, 91%, 92%, 93%, 94%, 95%, 96%, 97%, 98%, 99% or 100% sequence identity to a sequence identified herein by any one of the sequences in Tables 4a-4h. In some embodiments, the biologically active polypeptide identified herein by any one or combination of the sequences in Tables 4a-4h and 8a-8b.

In some embodiments, the BPXTEN polypeptide advantageously has a terminal half-life that is at least two-fold longer compared to the biologically active polypeptide not linked to any XTEN.

In some embodiments, the BPXTEN polypeptide advantageously is less immunogenic compared to the biologically active polypeptide not linked to any XTEN, wherein immunogenicity can be ascertained by measuring production of IgG antibodies that selectively bind to the biologically active polypeptide after administration of comparable doses to a human or animal.

In some embodiments, the BPXTEN polypeptide exhibits an apparent molecular weight factor under physiological conditions that is greater than about 6.

In some embodiments, the BPXTEN polypeptide further comprises a second XTEN polypeptide wherein the second XTEN polypeptide comprises an amino acid sequence having the same characteristics as set forth above and throughout this disclosure for the first XTEN component of these embodiments of the BPXTEN, and wherein the first XTEN polypeptide is located N-terminal of the biologically active polypeptide and the second XTEN polypeptide is located C-terminal of the biologically active polypeptide. In some embodiments, the second XTEN polypeptide comprises an amino acid sequence that differs from the amino acid sequence of the first XTEN comprising these embodiments of the BPXTEN. In certain embodiments the amino acid sequence of the second XTEN polypeptide is longer than the amino acid sequence of the first XTEN polypeptide.

In some embodiments, the BPXTEN polypeptide further comprises a second release segment (RS2) located between the biologically active polypeptide and the second XTEN polypeptide. In some embodiments, the RS1 of the first XTEN polypeptide and RS2 of the second XTEN polypeptide are identical in sequence. In some embodiments, the RS1 of the first XTEN polypeptide and RS2 of the second XTEN polypeptide are each a substrate for cleavage by multiple proteases at one, or two, or three, or more cleavage sites within each release segment sequence.

In some of these embodiments, the BPXTEN polypeptide comprises a further barcode fragment that is a portion of the second XTEN polypeptide and differs in sequence and molecular weight from all other peptides fragments that are releasable from the polypeptide upon complete digestion of the polypeptide by protease. In some of these embodiments, the further barcode fragment does not include the C-terminal amino acid of the polypeptide. In some of these embodiments, the further barcode fragment comprises a glutamic acid residue at its C-terminus. In some of these embodiments, the further barcode fragment of the second XTEN polypeptide is located within 200, within 150, within 100, or within 50 amino acids of the C-terminus of the second XTEN component of the BPXTEN polypeptide. In some of these embodiments, the further barcode fragment of the second XTEN polypeptide is located at a location that is between 10 and 200, between 30 and 200, between 40 and 150, or between 50 and 100 amino acids from the C-terminus of the second XTEN component of the BPXTEN polypeptide. In some of these embodiments, the further barcode fragment is between 4 and 20, between 5 and 15, between 6 and 12, or between 7 and 10 amino acids in length. In some of these embodiments, the further barcode fragment is identified herein by SEQ ID Nos: 8020-8030 (BAR001-BAR011).

In some embodiments, the second XTEN polypeptide further comprises a set of barcode fragments that includes the further barcode fragment and at least one additional barcode fragment, wherein each barcode fragment of the set of barcode fragments differs in sequence and molecular weight from all other peptides fragments that are releasable from the BPXTEN polypeptide upon complete digestion of the polypeptide by the protease. In some embodiments, the second XTEN polypeptide is identified by SEQ ID NOs: 8001-8019. In some embodiments, the further barcode fragment does not include a glutamic acid residue that is immediately adjacent to another glutamic acid residue in the polypeptide.

In some embodiments, at least 91%, 92%, 93%, 94%, 95%, 96%, 97%, 98%, 99% or 100% of the amino acid residues of the second XTEN polypeptide are a combination of glycine (G), alanine (A), serine (S), threonine (T), glutamate (E) and proline (P), wherein the XTEN polypeptide comprises at least four of these amino acids (G, A, S, T, E, or P). In some embodiments, the sum of the total number of amino acids in the first XTEN polypeptide and the total number of amino acids in the second XTEN polypeptide is at least 300, at least 350, at least 400, at least 500, at least 600, at least 700, or at least 800 amino acids. In some embodiments, the second XTEN polypeptide comprises a plurality of non-overlapping sequence motifs, wherein each of said sequence motifs is repeated at least two times in the second XTEN polypeptide sequence and is between 9 and 14 amino acids in length.

In some embodiments, for the second XTEN polypeptide, the sequence motifs of the plurality of non-overlapping sequence motifs are identified herein by SEQ ID NOs: 182-203 and 1715-1722. In some embodiments, the sequence motifs of the plurality of non-overlapping sequence motifs are identified herein by SEQ ID NOs: 186-189. In some embodiments, for the second XTEN polypeptide, the plurality of non-overlapping sequence motifs comprise at least two, at least three, or all four of the following motifs: SEQ ID NOs: 186-189. In some embodiments, the second XTEN polypeptide is from 150 to 3000 amino acids in length. In some embodiments, the second XTEN polypeptide is from 150 to 1000 amino acids in length. In some embodiments, the second XTEN polypeptide has at least 90%, at least 92%, at least 95%, at least 98%, at least 99% or 100% sequence identity to sequence identified herein by SEQ ID NOs: 8001-8019. In some embodiments, the second XTEN polypeptide is at least 200, at least 250, at least 300, at least 350, at least 400, at least 450, or at least 500 amino acids in length.

In particular embodiments, the BPXTEN polypeptides provided herein comprise a first XTEN polypeptide comprising a first RS sequence proximal but not comprising the C-terminus of the polypeptide, covalently linked to a first and second biologically active polypeptide covalently linked in tandem, wherein a second XTEN polypeptide is covalently linked to the C-terminus of the tandemly linked biologically active polypeptides, wherein the second XTEN polypeptide comprises a second RS sequence proximal to but not comprising the N-terminus of the second XTEN polypeptide, wherein the first and second RS sequences can be the same or different. In particular embodiments, the second XTEN polypeptide comprises an amino acid sequence that is longer than the amino acid sequence of the first XTEN polypeptide. In certain embodiments the first or second biologically active protein or both comprises a specific binding protein, in certain embodiments wherein the specific binding protein specifically binds to an antigen or agonist expressed at a desired biological site. In particular embodiments the desired biological site is a tumor and the antigen is a tumor-specific antigen. In particular embodiments the first and second biologically active polypeptide are different, including but not limited to have different specific binding affinities.

Further disclosed herein is a nucleic acid comprising a polynucleotide encoding a polypeptide such as any XTEN or BPXTEN polypeptide disclosed herein or the reverse complement of said polynucleotide.

Also disclosed herein is an expression vector comprising any polynucleotide sequence such disclosed herein and a regulatory sequence operably linked to the polynucleotide sequence that regulates expression or other biological activity of said polynucleotide.

Disclosed herein is a host cell comprising an expression vector as disclosed herein. In some embodiments, the host cell is a prokaryote. In some of these embodiments, the host cell is *E. coli*. In some alternative embodiments, the host cell is a mammalian cell.

Additionally disclosed herein is a pharmaceutical composition comprising a polypeptide as disclosed herein and one or more pharmaceutically acceptable excipients. In some embodiments, the pharmaceutical composition is formulated for administration to an animal and in particular a human, wherein said administration can be by any therapeutically effective administration route Pharmaceutical compositions as disclosed herein can be prepared and used in any formulation known in the art and particularly adapted to administration route, site, and intended effect on the human or animal.

Disclosed herein is use of a polypeptide as disclosed herein and particularly a BPXTEN polypeptide in the preparation of a medicament for the treatment of a disease, disorder, or condition in a human or animal. In some embodiments, the disease, disorder, or condition can be cancer.

Disclosed herein is a method of treating a disease in a human or animal human or animal as disclosed hereinabove and throughout this disclosure, the method comprising administering to the human or animal in need thereof one or more therapeutically effective doses of a pharmaceutical composition. In some embodiments, the pharmaceutical composition is administered to the human or animal as one or more therapeutically effective doses administered on a clinically appropriate schedule daily, weekly, monthly, or annually and at a clinically appropriate dose Disclosed herein is a mixture comprising a plurality of polypeptides, particularly XTEN and BPXTEN polypeptides as disclosed herein of varying length, the mixture comprising:

- a first set of polypeptides, wherein each polypeptide of the first set of polypeptides comprises a barcode fragment that is releasable from the polypeptide by digestion with a protease and has a sequence and molecular weight that differs from the sequence and molecular weight of all other fragments that are releasable from the first set of polypeptides; and
- a second set of polypeptides lacking the barcode fragment of the first set of polypeptides;
- wherein both the first set of polypeptides and the second set of polypeptides each comprise a reference fragment that is common to first set of polypeptides and the second set of polypeptides and produced by digestion with the protease; and
- wherein the ratio of the first set of polypeptides to polypeptides comprising the reference fragment is greater than 0.7.

In some embodiments, ratio of the first set of polypeptides to polypeptides comprising the reference fragment is greater than 0.8, 0.9, 0.95, or 0.98. In some embodiments, the reference fragment occurs no more than once in each polypeptide of the first set of polypeptides and the second set of polypeptides. In some embodiments, the protease is a protease that cleaves on the C-terminal side of glutamic acid residues. In some embodiments, barcode release from polypeptides comprising the first set of polypeptides is facilitated by pepsin, elastase, thermolysin, or Glu-C proteases. In some embodiments, barcode release is facilitated by Glu-C protease. In some embodiments, the protease is not trypsin. In some embodiments, the polypeptides of varying lengths comprise polypeptides comprising at least one XTEN polypeptide as set forth herein.

In some embodiments, the first set of polypeptides comprises a full-length polypeptide, wherein the barcode fragment is a portion of the full-length polypeptide. In some embodiments, the full-length polypeptide is any polypeptide disclosed herein and particularly XTEN and BPXTEN polypeptides. In some embodiments, the barcode fragment does not comprise either the N-terminal amino acid or C-terminal amino acid of the full-length polypeptide. In some embodiments, the mixture of polypeptides of varying lengths differ from one another due to N-terminal truncation, C-terminal truncation, or both N- and C-terminal truncation of a full-length polypeptide.

Disclosed herein is a method for assessing, in a mixture comprising polypeptides of varying length, and in particular XTEN and BPXTEN polypeptides as disclosed herein, a relative amount of a first set of polypeptides in the mixture to a second set of polypeptides in the mixture, wherein each polypeptide of the first set of polypeptides shares a barcode fragment that occurs once and only once in the polypeptide and each polypeptide of the second set of polypeptides lacks the barcode fragment that is shared by polypeptides of the first set, wherein individual polypeptides of both the first set of polypeptides and the second set of polypeptides each comprises a reference fragment, the method comprising:

- contacting the mixture with a protease to produce a plurality of proteolytic fragments that result from cleavage of the first set of polypeptides and the second set of polypeptides, wherein the plurality of proteolytic fragments comprise a plurality of reference fragments and a plurality of barcode fragments; and
- determining a ratio of the amount of barcode fragments to the amount of reference fragments, thereby assessing the relative amounts of the first set of polypeptides to the second set of polypeptides.

In some embodiments, the reference fragment occurs no more than once in each polypeptide of the first set of polypeptides and the second set of polypeptides.

In some embodiments, the protease cleaves the polypeptides of varying length on the C-terminal side of glutamic acid residues that are not followed by a proline residue. In some embodiments, the protease is a Glu-C protease. In some embodiments, the protease is not trypsin. In some embodiments, determining a ratio of the amount of barcode fragments to the amount of reference fragments comprises quantifying barcode fragments and reference fragments from the mixture after the mixture of polypeptides has been contacted with the protease. In some embodiments, the barcode fragments and the reference fragments are identified based their respective masses. In some embodiments, the barcode fragments and the reference fragments are identified via mass spectrometry. In some embodiments, the barcode fragments and reference fragments are identified via liquid chromatography-mass spectrometry (LC-MS). In some embodiments, determining a ratio of the barcode fragments to the reference fragments comprises isobaric labeling or stable isotope labeling. In some embodiments, determining a ratio of the barcode fragments to the reference fragments comprises spiking the mixture with one or both of an isotope-labeled reference fragment and an isotope labeled barcode fragment.

In some of these embodiments, the polypeptides of varying length comprise a full-length polypeptide and truncated fragments thereof. In some of these embodiments, the mixture of polypeptides of varying lengths differ from one another due to N-terminal truncation, C-terminal truncation, or both N- and C-terminal truncation of a full-length polypeptide. In some of these embodiments, the ratio of the amount of barcode fragments to reference fragments is greater than 0.5, 0.6, 0.7, 0.8, 0.9, 0.95, 0.98, or 0.99.

Disclosed herein is a mixture comprising a plurality of polypeptides of varying length, the mixture comprising a first set of polypeptides, wherein each polypeptide of the first set of polypeptides comprises a barcode fragment that is releasable from the polypeptide by digestion with a protease and has a sequence and molecular weight that differs from the sequence and molecular weight of all other fragments that are releasable from the first set of polypeptides. Said embodiment also includes a second set of polypeptides lacking the barcode fragment of the first set of polypeptides, wherein both the first set of polypeptides and the second set of polypeptides each comprise a reference fragment that is common to first set of polypeptides and the second set of polypeptides and releasable by digestion with the protease. In said embodiment the number of reference fragments quantified in the polypeptide mixture after protease digestion is equal to the sum of the number of the first and second set of polypeptides in the mixture, and the number of barcode fragments quantified in the polypeptide mixture after protease digestion is equal to the number of the first set of polypeptides in the mixture. In said embodiment the first set of polypeptides comprises one reference fragment the ratio of the first set of polypeptides to polypeptides in the mixture comprising the reference fragment is greater than 0.7.

In some embodiments the mixture has a ratio of the first set of polypeptides to polypeptides comprising the reference fragment greater than 0.8, 0.9, or 0.95.

In a particular embodiment the reference fragment occurs no more than once in each polypeptide of the first set of polypeptides and the second set of polypeptides. In alternative embodiments the reference fragment occurs twice in each polypeptide of the first set of polypeptides and the second set of polypeptides.

In some embodiments the first set of polypeptides comprises a full-length polypeptide, wherein the barcode fragment is a portion of the full-length polypeptide.

In some embodiments the full-length polypeptide includes the polypeptides disclosed herein.

In a particular embodiment the mixture barcode fragment does not comprise the N-terminal amino acid and C-terminal amino acid of the full-length polypeptide.

In some embodiments the mixture contains polypeptides of varying lengths that differ from one another due to N-terminal truncation, C-terminal truncation, or both N-terminal and C-terminal truncation of a full-length polypeptide.

In some embodiments the reference fragment occurs no more than once in each polypeptide of the first set of polypeptides and the second set of polypeptides. In an alternative embodiment the number of reference fragments in the first set of polypeptides can differ from the number of reference fragments in the second set of polypeptides but the number thereof in each polypeptide of each set must be the same.

In one particular embodiment, each of the reference fragments in the polypeptides of the mixture has a sequence and molecular weight that differs from the sequence and molecular weight of all other fragments.

Disclosed herein is a mixture comprising a plurality of polypeptides of varying length, the mixture comprising a first set of polypeptides, wherein each polypeptide of the first set of polypeptides comprises a barcode fragment that is releasable from the polypeptide by digestion with a protease and has a sequence and molecular weight that differs from the sequence and molecular weight of all other fragments that are releasable from the first set of polypeptides. The mixture further comprises a second set of polypeptides lacking the barcode fragment of the first set of polypeptides wherein both the first set of polypeptides and the second set of polypeptides each comprise a reference fragment that is common to first set of polypeptides and the second set of polypeptides and releasable by digestion with the protease. The ratio of the first set of polypeptides to polypeptides in the mixture has the formula:

$$[\text{barcode-containing polypeptides}]/[(\text{reference peptide-containing polypeptides})\times N]$$

where N is the number of occurrences of the reference peptide that is released from each polypeptide in the mixture, and wherein when the first set of polypeptides comprises one reference fragment the ratio of the first set of polypeptides to polypeptides in the mixture comprising the reference fragment is greater than 0.7.

In a particular embodiment the ratio of the first set of polypeptides to polypeptides comprising the reference fragment is greater than 0.8, 0.9, or 0.95.

In some embodiments the reference fragment in the occurs no more than once in each polypeptide of the first set of polypeptides and the second set of polypeptides.

In some embodiments the reference fragment occurs twice in each polypeptide of the first set of polypeptides and the second set of polypeptides.

In a particular embodiment the first set of polypeptides comprises a full-length polypeptide, wherein the barcode fragment is a portion of the full-length polypeptide.

In some embodiments the full-length polypeptide includes the polypeptides disclosed herein. In a particular embodiment the barcode fragment does not comprise the N-terminal amino acid and C-terminal amino acid of the full-length polypeptide.

In some embodiments the mixture of polypeptides of varying lengths differ from one another due to N-terminal truncation, C-terminal truncation, or both N-terminal and C-terminal truncation of a full-length polypeptide.

In some embodiments the reference fragment occurs no more than once in each polypeptide of the first set of polypeptides and the second set of polypeptides. In further embodiments the number of reference fragments in the first set of polypeptides can differ from the number of reference fragments in the second set of polypeptides but the number thereof in each polypeptide of each set must be the same. In some embodiments the reference fragments in the polypeptides of the mixture has a sequence and molecular weight that differs from the sequence and molecular weight of all other fragments.

Disclosed herein is a method of detecting sequence integrity of polypeptides comprising the first set of polypeptides in the mixture disclosed herein, the method comprising the steps of digesting the mixture of polypeptides with a protease that releases the barcode fragment and the reference fragment from the first set of polypeptides and releases the reference fragment from the second set of polypeptides, and determining a ratio of the barcode fragments from the first set of polypeptides to the reference fragments from the first and second set of polypeptides. In a particular embodiment the sequence integrity of polypeptides of the first set of polypeptides are detected by a comparison of the ratio of the fragments to the expected ratio of the fragments based on the number of barcode fragments and reference fragments in polypeptides comprising the first and second set of polypeptides.

The methods contemplated herein are readily amenable to qualitative and quantitative analysis of the polypeptides that contain the barcodes and/or reference fragments, for example by use of LC/MS. In one particular embodiment, the LC/MS is quantitative and detects an isotopically distinguishable amount of bar code fragments, reference fragments, or both. In exemplary such methods, the mixture of polypeptides is spiked with a known amount of a "standard material" to facilitate such analysis. For example, such a standard material is one which comprises an isotopically-labelled version of said mixture of a plurality of polypeptides of varying length that are to be analyzed. This isotopically labelled standard may be added to the mixture as a complete sequence prior to digestion by said protease. Alternatively, the test sample of the mixture of polypeptides of varying length and the isotopically labelled standard material are digested by the protease in separate reactions and the protease-digested isotopically labelled standard material is added to the test sample prior to analysis by LC/MS. The methods of the present invention, further comprise quantitating the amount of bar code fragments, reference fragments or both from the test sample by comparison to the quantification of the detected isotopically distinguishable amounts of bar code fragments, reference fragments, or both.

Variations and modifications of these embodiments will occur to those of skill in the art after reviewing this disclosure. The foregoing features and aspects can be implemented, in any combination and sub-combinations (including multiple dependent combinations and sub-combinations), with one or more other features described herein. The various features described or illustrated above, including any components thereof, can be combined or integrated in other embodiments. Moreover, certain features can be omitted or not implemented.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

Various features of this disclosure are set forth with particularity in the appended claims. A better understanding of the features and advantages of the present disclosure can be obtained by reference to the following detailed description that sets forth illustrative embodiments, in which the principles of the invention are utilized, and the accompanying drawings of which:

As illustrated in FIG. 1 using the full-length XPAT, each XTEN polypeptide has a proximal end and a distal end, wherein the proximal end is located, relative to the distal end, closer to the biologically active polypeptide (e.g., T-cell engager, cytokine, monoclonal antibody (mAb), antibody fragment, or other protein that is XTENylated). Depending on linkage orientation the proximal or distal ends of the XTEN polypeptide can correspond to the XTEN polypeptide's N-terminus or C-terminus.

FIG. 4A demonstrates that a barcoded XTEN polypeptide (bottom panel) can be constructed by replacing a sequence motif in a general-purpose XTEN polypeptide (top panel) (e.g., the third sequence motif from the N-terminus, "D") with a barcode-generating motif, "X"; and, in this example, the barcode-generating motif ("X") is itself the unique proteolytically cleavable barcode sequence. As shown in the bottom panel in FIG. 4A, the barcode is located wherein all the severe truncation forms of the XTEN polypeptide lack the barcode, and all the limited truncation forms of the XTEN polypeptide contain the barcode. FIG. 4B illustrates the relative abundance of various cleavage products in two different mixtures of XPAT. In one of the mixtures, the barcode is present in 99% of the constructs that contain the biologically active protein. In the other one of the mixtures, 13% of the constructs are lack a barcode. FIGS. 4A-4B illustrate the use of barcoded XTEN polypeptide to differentiate between two polypeptide mixtures having substantially similar average molecular weights but discernibly different pharmacological activities.

TERMINOLOGY

Figure 1:
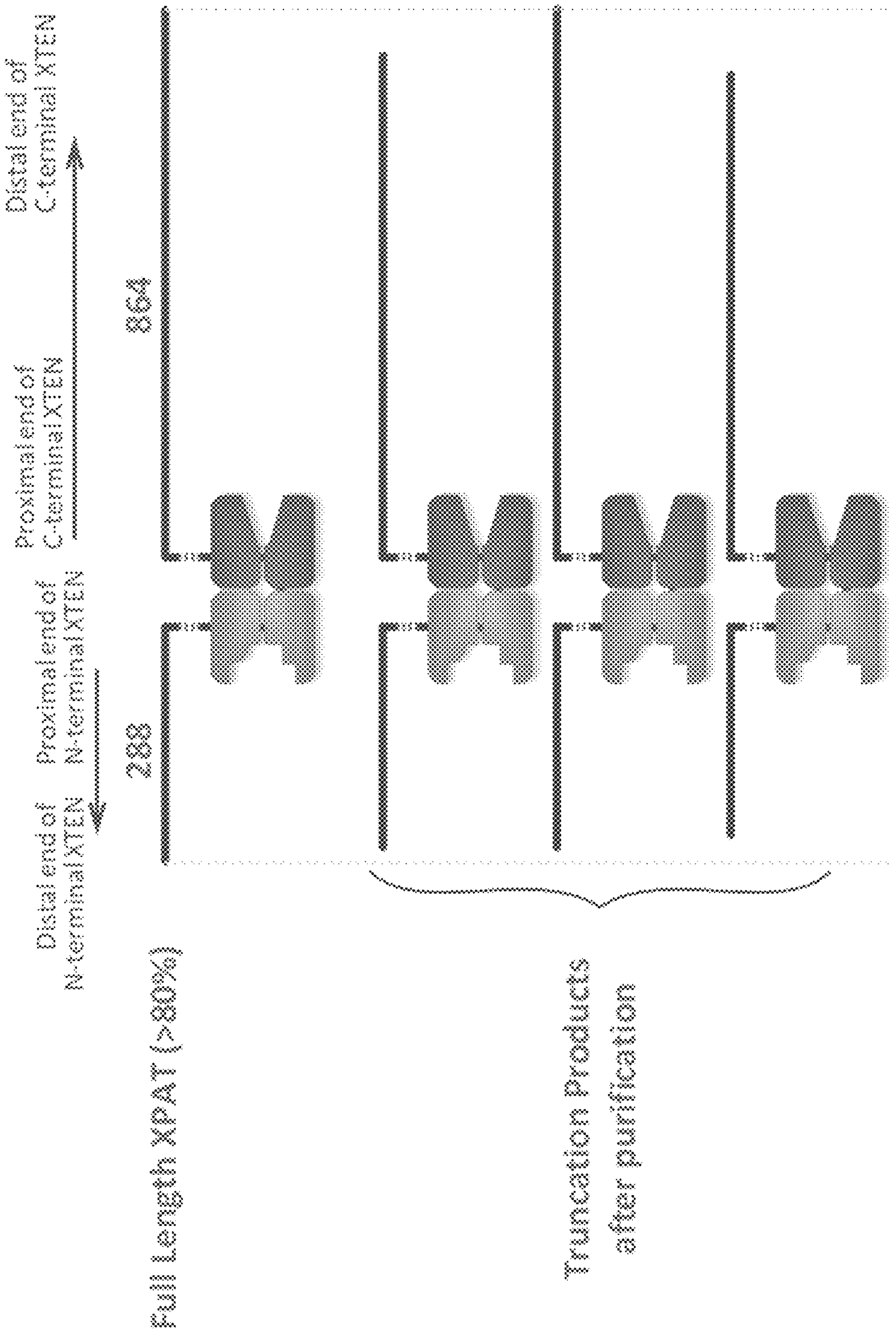
FIG. 1 depicts a mixture of XTENylated Protease-Activated T Cell Engager ("XPAT") polypeptides having varying lengths of XTEN polypeptides. The full-length XPAT (top) comprises a 288 amino acid-long XTEN polypeptide at the N-terminus and a 864 amino acid-long XTEN polypeptide at the C-terminus. Various truncations can occur in the XPAT in one or both of the N- and C-terminal XTEN polypeptides, for example, during fermentation, purification or other steps in product preparation. While products having limited truncations (truncations near a portion of the XTEN polypeptide distal from the Protease-Activated T Cell Engager linked thereto) can function in a manner similar to the full-length construct, severe truncations (truncations closer to a portion of the XTEN polypeptide proximal from Protease-Activated T Cell Engager linked thereto) can possess significantly different pharmacological properties from their full-length counterparts. The presence of truncations poses a challenge for quantifying the pharmacologically efficacious and inefficacious variants in an XPAT product.

As used herein, the following terms have the meanings ascribed to them unless specified otherwise.

As used in the specification and claims, the singular forms "a," "an," and "the" include plural references unless the context clearly dictates otherwise. For example, the term "a cell" includes a plurality of cells, including mixtures thereof.

The terms "polypeptide," "peptide," and "protein" are used interchangeably herein to refer to polymers of amino acids of any length. The polymer can be linear or branched, it can comprise modified amino acids, and it can be interrupted by non-amino acids. The terms also encompass an amino acid polymer that has been modified, for example, by disulfide bond formation, glycosylation, lipidation, acetylation, phosphorylation, or any other manipulation, such as conjugation with a labeling component.

As used herein the term "amino acid" refers to either natural and/or unnatural or synthetic amino acids, including but not limited to glycine and both the D or L optical isomers, and amino acid analogs and peptidomimetics. Standard single or three letter codes are used to designate amino acids.

A "host cell" includes an individual cell or cell culture which can be or has been a recipient for the human or animal vectors. Host cells include progeny of a single host cell. The progeny are not necessarily completely identical (in morphology or in genomic of total DNA complement) to the original parent cell due to naturally occurring or genetically engineered variation.

A "chimeric" protein contains at least one polypeptide comprising regions in a different position in the sequence than that which occurs in nature. The regions can normally exist in separate proteins and are brought together in the fusion polypeptide; or they can normally exist in the same protein but are placed in a new arrangement in the fusion polypeptide. Said proteins can be described as "conjugated," "linked," "fused," or "fusion" proteins; these terms are used interchangeably herein and refer to the joining together of two more polypeptide sequences by whatever means including chemical conjugation or recombinant means. A chimeric protein can be created, for example, by chemical synthesis, or by creating and translating a polynucleotide in which the peptide regions are encoded in the desired relationship.

The terms "polynucleotides," "nucleic acids," "nucleotides," and "oligonucleotides" are used interchangeably and refer to a polymeric form of nucleotides of any length, either deoxyribonucleotides or ribonucleotides, or analogs thereof. Polynucleotides can have any three-dimensional structure, and can perform any function, known or to be discovered or developed. A polynucleotide can comprise modified nucleotides, such as methylated nucleotides and nucleotide analogs. If present, modifications to the nucleotide structure can be imparted before or after assembly of the polymer. The sequence of nucleotides can be interrupted by non-nucleotide components. A polynucleotide can be further modified after polymerization, such as by conjugation with a labeling component.

The term "complement of a polynucleotide" denotes a polynucleotide molecule having a complementary base sequence and reverse orientation as compared to a reference sequence, wherein it could hybridize with a reference sequence with complete fidelity.

As used herein, polynucleotides having "homology" or that are "homologous" are those which hybridize under stringent conditions as defined herein and have at least 70%, preferably at least 80%, more preferably at least 90%, more preferably 95%, more preferably 97%, more preferably 98%, and even more preferably 99% sequence identity to those sequences.

The terms "percent identity" and "% identity," as applied to polynucleotide sequences, refer to the percentage of residue matches between at least two polynucleotide sequences aligned using a standardized algorithm. Such an algorithm can insert, in a standardized and reproducible way, gaps in the sequences being compared in order to optimize alignment between two sequences, and therefore achieve a more meaningful comparison of the two sequences. Percent identity can be measured over the length of an entire defined polynucleotide sequence, for example, as defined by a particular SEQ ID number, or can be measured over a shorter length, for example, over the length of a fragment taken from a larger, defined polynucleotide sequence, for instance, a fragment of at least 45, at least 60, at least 90, at least 120, at least 150, at least 210 or at least 450 contiguous residues. Such lengths are exemplary only, and it is understood that any fragment length supported by the sequences shown herein, in the tables, figures or Sequence Listing, can be used to describe a length over which percentage identity can be measured.

"Percent (%) amino acid sequence identity," with respect to the polypeptide sequences identified herein, is defined as the percentage of amino acid residues in a query sequence that are identical with the amino acid residues of a second, reference polypeptide sequence or a portion thereof, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. Percent identity can be measured over the length of an entire defined polypeptide sequence, for example, as defined by a particular SEQ ID number, or can be measured over a shorter length, for example, over the length of a fragment taken from a larger, defined polypeptide sequence, for instance, a fragment of at least 15, at least 20, at least 30, at least 40, at least 50, at least 70 or at least 150 contiguous residues. Such lengths are exemplary only, and it is understood that any fragment length supported by the sequences shown herein, in the tables, figures or Sequence Listing, can be used to describe a length over which percentage identity can be measured.

As used herein, "repetitiveness" of an XTEN polypeptide amino acid sequence refers to 3-mer repetitiveness and can be measured by computer programs or algorithms or by other means known in the art. The 3-mer repetitiveness of an XTEN polypeptide amino acid sequence can be assessed by determining the number of occurrences of the overlapping 3-mer sequences within the polypeptide. For example, a polypeptide of 200 amino acid residues has 198 overlapping 3-amino acid sequences (3-mers), but the number of unique 3-mer sequences depends on the amount of repetitiveness within the sequence. A score can be generated (hereinafter "subsequence score") that is reflective of the degree of repetitiveness of the 3-mers in the overall polypeptide sequence. In the context of the present invention, "subsequence score" means the sum of occurrences of each unique 3-mer frame across a 200 consecutive amino acid sequence of the polypeptide divided by the absolute number of unique 3-mer subsequences within the 200 amino acid sequence. Examples of such subsequence scores derived from the first 200 amino acids of repetitive and non-repetitive polypeptides are presented in Example 73 of International Patent Application Publication No. WO 2010/091122 A1, which is incorporated by reference in its entirety. In some embodiments, the present invention provides BPXTEN polypeptides each comprising at least one XTEN polypeptide in which the XTEN polypeptide amino acid sequence can have a subsequence score less than 16, or less than 14, or less than 12, or more preferably less than 10.

The term "substantially non-repetitive XTEN polypeptide amino acid sequence," as used herein, refers to an XTEN polypeptide, wherein there are few or no instances of four contiguous amino acids in the XTEN polypeptide amino acid sequence that are identical amino acid types and wherein the XTEN polypeptide amino acid sequence has a subsequence score (defined in the preceding paragraph herein) of 12, or 10 or less or that there is not a pattern in the order, from N- to C-terminus, of the sequence motifs that constitute the polypeptide sequence.

As set forth herein, the term "non-overlapping sequence motifs" includes sequence motifs that are completely non-overlapping as well as sequence motifs that are only partially non-overlapping, provided that said partially non-overlapping sequence motifs are not completely overlapping.

A "vector" is a nucleic acid molecule, preferably self-replicating in an appropriate host, which transfers an inserted nucleic acid molecule into and/or between host cells. The term includes vectors that function primarily for insertion of DNA or RNA into a cell, replication of vectors that function primarily for the replication of DNA or RNA, and expression vectors that function for transcription and/or translation of the DNA or RNA. Also included are vectors that provide more than one of the above functions. An "expression vector" is a polynucleotide which, when introduced into an appropriate host cell, can be transcribed and translated into a polypeptide(s). An "expression system" usually connotes a suitable host cell comprised of an expression vector that can function to yield a desired expression product.

The term "$t_{1/2}$" as used herein means the terminal half-life calculated as $\ln(2)/K_{el}$. $K_{el}$ is the terminal elimination rate constant calculated by linear regression of the terminal linear portion of the log concentration vs. time curve. Half-life typically refers to the time required for half the quantity of an administered substance deposited in a living organism to be metabolized or eliminated by normal biological processes. The terms "$t_{1/2}$", "terminal half-life", "elimination half-life" and "circulating half-life" are used interchangeably herein.

The terms "antigen," "target antigen," or "immunogen" are used interchangeably herein to refer to the structure or binding determinant that an antibody fragment or an antibody fragment-based therapeutic binds to or has specificity against.

The term "payload" as used herein refers to a protein or peptide sequence that has biological or therapeutic activity; the counterpart to the pharmacophore of small molecules. Examples of payloads include, but are not limited to, cytokines, enzymes, hormones and blood and growth factors. Payloads can further comprise genetically fused or chemically conjugated moieties such as chemotherapeutic agents, antiviral compounds, toxins, or contrast agents. These conjugated moieties can be joined to the rest of the polypeptide via a linker which can be cleavable or non-cleavable.

As used herein, "treatment" or "treating," "palliating," and "ameliorating" are used interchangeably herein and refer to an approach for obtaining beneficial or desired results including but not limited to a therapeutic benefit and/or a prophylactic benefit. By "therapeutic benefit" is meant eradication or amelioration of the underlying disorder being treated. Also, a therapeutic benefit is achieved with the eradication or amelioration of one or more of the physiological symptoms associated with the underlying disease condition wherein an improvement is observed in the human or animal, notwithstanding that the human or animal can still be afflicted with the underlying disorder. For prophylactic benefit, the compositions can be administered to a human or animal at risk of developing a particular disease condition, or to a human or animal reporting one or more of the physiological symptoms of a disease, even though a diagnosis of this disease cannot have been made.

A "therapeutic effect," as used herein, refers to a physiologic effect, including but not limited to the cure, mitigation, amelioration, or prevention of disease condition in humans or other animals, or to otherwise enhance physical or mental wellbeing of humans or animals, caused by a fusion polypeptide of the invention other than the ability to induce the production of an antibody against an antigenic epitope possessed by the biologically active protein. Determination of a therapeutically effective amount is well within the capability of those skilled in the art, especially in light of the detailed disclosure provided herein.

The terms "therapeutically effective amount" and "therapeutically effective dose," as used herein, refers to an amount of a biologically active protein, either alone or as a part of a fusion protein composition, that is capable of having any detectable, beneficial effect on any symptom, aspect, measured parameter or characteristics of a disease state or condition when administered in one or repeated doses to a human or animal. Such effect need not be absolute to be beneficial. The disease condition can refer to a disorder or a disease.

The term "therapeutically effective dose regimen," as used herein, refers to a schedule for consecutively administered doses of a biologically active protein, either alone or as a part of a fusion protein composition, wherein the doses are given in therapeutically effective amounts to result in sustained beneficial effect on any symptom, aspect, measured parameter or characteristics of a disease state or condition.

Fusion Polypeptide

Disclosed herein are polypeptides comprising one or more extended recombinant polypeptides (XTEN or XTENs) (as described more fully hereinbelow) that can be fused or otherwise conjugated to another polypeptide, particularly a biologically active polypeptide, wherein said embodiments are termed BPXTEN herein.

In some embodiments, the polypeptide comprises a first XTEN polypeptide (such as those described below in the "EXTENDED RECOMBINANT POLYPEPTIDE (XTEN)" section or described anywhere else herein). In some embodiments, the polypeptide further comprises a second XTEN polypeptide (such as those described below in the "EXTENDED RECOMBINANT POLYPEPTIDE (XTEN)" section or described anywhere else herein). In some embodiments, the polypeptide comprises an XTEN polypeptide at or near its N-terminus (an "N-terminal XTEN"). In some embodiments, the polypeptide comprises an XTEN polypeptide at or near its C-terminus (a "C-terminal XTEN"). In some embodiments, the polypeptide comprises both an N-terminal XTEN polypeptide and a C-terminal XTEN polypeptide. In some embodiments, the first XTEN polypeptide is an N-terminal XTEN polypeptide and the second XTEN polypeptide is a C-terminal XTEN polypeptide.

The polypeptide can further comprise a biologically active polypeptide ("BP") linked to the XTEN polypeptide, thereby forming a XTEN-containing fusion polypeptide termed an "BPXTEN" polypeptide herein.

The XTEN polypeptide can comprise one or more barcode fragments (as described more fully below) releasable (configured to be released) from the XTEN polypeptide upon digestion of the fusion polypeptide (or BPXTEN) by a protease. In some embodiments, each barcode fragment differs in sequence and molecular weight from all other peptide fragments (including all other barcode fragments if present) that are releasable from the polypeptide upon complete digestion of the polypeptide by the protease.

The (fusion) polypeptide can comprise one or more reference fragments (as described more fully below) releasable (configured to be released) from the polypeptide, for example, upon the protease digestion which releases the barcode fragment(s) from the polypeptide. In some embodiments, each reference fragment can be a single reference fragment that differs in sequence and molecular weight from all other peptide fragments that are releasable from the polypeptide upon digestion of the polypeptide by the protease.

Extended Recombinant Polypeptide (Xten)

Chain Length and Amino Acid Composition

In some embodiments, the XTEN polypeptide comprises at least 150 amino acids. In some embodiments, the XTEN polypeptide is from 150 to 3,000 amino acids in length, or from 150 to 1,000 amino acids in length, or at least 200, at least 250, at least 300, at least 350, at least 400, at least 450, or at least 500 amino acids in length. In some embodiments, at least 90% of the amino acid residues of the XTEN polypeptide are glycine (G), alanine (A), serine (S), threonine (T), glutamate (E) or proline (P). In some embodiments, at least 91%, 92%, 93%, 94%, 95%, 96%, 97%, 98%, 99% or 100% of the amino acid residues of the XTEN polypeptide are selected from G, A, S, T, E, or P. In some embodiments, the XTEN polypeptide comprises at least 4 different types G, A, S, T, E, or P amino acids. In some embodiments, the XTEN polypeptide is characterized in that it comprises at least 150 amino acids; at least 90% of the amino acid residues of the XTEN polypeptide are G, A, S, T, E, or P and it comprises at least 4 different types of amino acids selected from G, A, S, T, E, and P that is substantially randomized with respect to any other nonoverlapping sequence motif comprising the XTEN polypeptide. In some embodiments, an XTEN-containing fusion polypeptide (e.g., a fusion polypeptide comprising a biologically active polypeptide conjugated therewith) comprises a first XTEN polypeptide and a second XTEN polypeptide. In some embodiments, the sum of the total number of amino acids in the first XTEN and the total number of amino acids in the second XTEN polypeptide is at least 300, at least 350, at least 400, at least 500, at least 600, at least 700, or at least 800 amino acids.

Non-Overlapping Sequence Motif

In some embodiments, the XTEN polypeptides provided herein comprise, or are formed from, a plurality of non-overlapping sequence motifs. In some embodiments, at least one of the non-overlapping sequence motifs is recurring (or repeated at least two times in the XTEN), and wherein at least another one of the non-overlapping sequence motifs is non-recurring (or found only once within the XTEN). In some embodiments, the plurality of non-overlapping sequence motifs comprises a set of (recurring) non-overlapping sequence motifs, wherein each of said sequence motifs is repeated at least two times in the XTEN; and a non-overlapping (non-recurring) sequence motif that occurs (or is found) only once within the XTEN. In some embodiments, each non-overlapping sequence motif is from 9 to 14 (or 10 to 14, or 11 to 13) amino acids in length. In some embodiments, each non-overlapping sequence motif is 12 amino acids in length. In some embodiments, the plurality of non-overlapping sequence motifs comprises a set of non-overlapping (recurring) sequence motifs, wherein each of said sequence motifs is repeated at least two times in the XTEN; and is between 9 and 14 amino acids in length. In some embodiments, the set of (recurring) non-overlapping sequence motifs comprises 12-mer sequence motifs identified herein by SEQ ID NOs: 182-203 and 1715-1722 in Table 1. In some embodiments, the set of (recurring) non-overlapping sequence motifs comprises 12-mer sequence motifs identified herein by SEQ ID NOs: 186-189 in Table 1. In some embodiments, the set of (recurring) non-overlapping sequence motifs comprise at least two, at least three, or all four of 12-mer sequence motifs of SEQ ID NOs: 186-189 in Table 1.

TABLE 1

Exemplary 12-Mer Sequence Motifs for Construction of XTENs

| Motif Family* | SEQ ID NO | Amino Acid Sequence |
|---|---|---|
| AD | 182 | GESPGGSSGSES |
| AD | 183 | GSEGSSGPGESS |
| AD | 184 | GSSESGSSEGGP |
| AD | 185 | GSGGEPSESGSS |
| AE, AM | 186 | GSPAGSPTSTEE |
| AE, AM, AQ | 187 | GSEPATSGSETP |
| AE, AM, AQ | 188 | GTSESATPESGP |
| AE, AM, AQ | 189 | GTSTEPSEGSAP |
| AF, AM | 190 | GSTSESPSGTAP |
| AF, AM | 191 | GTSTPESGSASP |
| AF, AM | 192 | GTSPSGESSTAP |

TABLE 1-continued

| Exemplary 12-Mer Sequence Motifs for Construction of XTENs | | |
|---|---|---|
| Motif Family* | SEQ ID NO | Amino Acid Sequence |
| AF, AM | 193 | GSTSSTAESPGP |
| AG, AM | 194 | GTPGSGTASSSP |
| AG, AM | 195 | GSSTPSGATGSP |
| AG, AM | 196 | GSSPSASTGTGP |
| AG, AM | 197 | GASPGTSSTGSP |
| AQ | 198 | GEPAGSPTSTSE |
| AQ | 199 | GTGEPSSTPASE |
| AQ | 200 | GSGPSTESAPTE |
| AQ | 201 | GSETPSGPSETA |
| AQ | 202 | GPSETSTSEPGA |
| AQ | 203 | GSPSEPTEGTSA |
| BC | 1715 | GSGASEPTSTEP |
| BC | 1716 | GSEPATSGTEPS |
| BC | 1717 | GTSEPSTSEPGA |
| BC | 1718 | GTSTEPSEPGSA |
| BD | 1719 | GSTAGSETSTEA |
| BD | 1720 | GSETATSGSETA |
| BD | 1721 | GTSESATSESGA |
| BD | 1722 | GTSTEASEGSAS |

*Denotes individual motif sequences that, when used together in various permutations, results in a "family sequence"

Barcode Fragment

In some embodiments, the polypeptides provided herein comprise a barcode fragment (e.g., a first, second, or third barcode fragment of an XTEN polypeptide) releasable from the polypeptide upon digestion by a protease. In some embodiments, the barcode fragment is a portion of the XTEN that includes at least part of the (non-recurring, non-overlapping) sequence motif that occurs (or is found) only once within the XTEN; and differs in sequence and molecular weight from all other peptide fragments that are releasable from the polypeptide upon complete digestion of the polypeptide by the protease. One of ordinary skill in the art will understand that the term "barcode fragment" (or "barcode," or "barcode sequence") can refer to either the portion of the XTEN identified herein by cleavably fused within the polypeptide, or the resulting peptide fragment released from the polypeptide.

In some embodiments, the barcode fragment does not include the N-terminal amino acid or the C-terminal amino acid of the XTEN polypeptide. As described more fully below or described anywhere herein, in some embodiments, the barcode fragment is releasable (configured to be released) upon Glu-C digestion of the fusion polypeptide. In some embodiments, the barcode fragment does not include a glutamic acid that is immediately adjacent to another glutamic acid in the XTEN polypeptide. In some embodiments, the barcode fragment has a glutamic acid at its C-terminus. One of ordinary skill in the art will understand that the C-terminus of a barcode fragment can refer to the "last" (or the most C-terminal) amino acid residue within the barcode fragment, when cleavably fused within an XTEN polypeptide, even if other "non-barcode" amino acid residues are located C-terminal to the barcode fragment within the same XTEN polypeptide. In some embodiments, the barcode fragment has an N-terminal amino acid that is immediately preceded by a glutamic acid residue. In some embodiments, the glutamic acid residue that precedes the N-terminal amino acid is not immediately adjacent to another glutamic acid residue. In some embodiments, the barcode fragment does not include a glutamic acid residue at a position other than the C-terminus of the barcode fragment unless the glutamic acid is immediately followed by a proline. In some embodiments, the barcode fragment is located from 10 to 150, or 10 to 125 amino acids from either the N-terminus of the polypeptide or the C-terminus of the polypeptide. In some embodiments, the barcode fragment is located within, or at a location of, 300, 280, 260, 250, 240, 220, 200, 190, 180, 170, 160, 150, 140, 130, 120, 110, 100, 90, 80, 70, 60, 50, 48, 40, 36, 30, 24, 20, 12, or 10 amino acids from the N-terminus of the polypeptide, or at a location in a range between any of the foregoing. In some embodiments, the barcode fragment is located within 200, within 150, within 100, or within 50 amino acids of the N-terminus of the polypeptide. In some embodiments, the barcode fragment is located between 10 and 200, between 30 and 200, between 40 and 150, or between 50 and 100 amino acids from the N-terminus of the polypeptide. In some embodiments, the barcode fragment is located within 300, 280, 260, 250, 240, 220, 200, 190, 180, 170, 160, 150, 140, 130, 120, 110, 100, 90, 80, 70, 60, 50, 48, 40, 36, 30, 24, 20, 12, or 10 amino acids from the C-terminus of the polypeptide, or in a range between any of the foregoing. In some embodiments, the barcode fragment is located within 200, within 150, within 100, or within 50 amino acids of the C-terminus of the polypeptide. In some embodiments, the barcode fragment is located between 10 and 200, between 30 and 200, between 40 and 150, or between 50 and 100 amino acids from the C-terminus of the polypeptide. In some embodiments, the barcode fragment does not include the N-terminal amino acid or the C-terminal amino acid of the polypeptide; does not include a glutamic acid that is immediately adjacent to another glutamic acid in the XTEN; has a glutamic acid at its C-terminus; has an N-terminal amino acid that is immediately preceded by a glutamic acid residue; and (v) is located from 10 to 150, or 10 to 125 amino acids from either the N-terminus of the polypeptide or the C-terminus of the polypeptide. In some embodiments, the glutamic acid residue that precedes the N-terminal amino acid is not immediately adjacent to another glutamic acid residue. In some embodiments, the barcode fragment does not include a glutamic acid residue at a position other than the C-terminus of the barcode fragment unless the glutamic acid is immediately followed by a proline. In some embodiments, for a barcoded XTEN polypeptide fused to a biologically-active polypeptide, at least one barcode fragment (or at least two barcode fragments, or three barcode fragments) contained in the barcoded XTEN is located at least 50, 75, 100, 125, 150, 175, 200, 225, 250, 275, 300 amino acids from the biologically active polypeptide. In some embodiments, the barcode fragment is at least 4, at least 5, at least 6, at least 7, or at least 8 amino acids in length. In some embodiments, the barcode fragment is at least 4 amino acids in length. In some embodiments, the barcode fragment is 4, 5, 6, 7, 8, 9, 10, 11, 12, 13, 14, 15, 16, 17, 18, 19, 20, 21, 22, 23, 24, 25 amino acids in length, or in a range between any of the foregoing values. In some embodiments, the barcode fragment is between 4 and 20, between 5 and 15, between 6 and 12, or between 7 and 10 amino acids in length. In some embodiments, the barcode fragment is selected from SEQ ID NOs: 8020-8030 (BAR001-BAR011) in Table 2.

TABLE 2

Exemplary Barcode Fragments Releasable Upon Glu-C Digest

| Amino Acid Sequence | | SEQ ID NO: |
|---|---|---|
| SPATSGSTPE | BAR001 | 8020 |
| GSAPATSE | BAR002 | 8021 |
| GSAPGTATE | BAR003 | 8022 |
| GSAPGTE | BAR004 | 8023 |
| PATSGPTE | BAR005 | 8024 |
| SASPE | BAR006 | 8025 |
| PATSGSTE | BAR007 | 8026 |
| GSAPGTSAE | BAR008 | 8027 |
| SATSGSE | BAR009 | 8028 |
| SGPGSTPAE | BAR010 | 8029 |
| SGSE | BAR011 | 8030 |

In some embodiments, a barcoded XTEN polypeptide comprises only one barcode fragment. In some embodiments, a barcoded XTEN polypeptide comprises a set of barcode fragments, comprising a first barcode fragment, such as those described above or anywhere else herein. In these embodiments, each member of the set of barcode sequences can be distinguished from all other barcode sequences on the basis of amino acid sequence or molecular weight (wherein these methods for distinguishing different barcode sequences will be related). In some embodiments, the set of barcode fragments comprises a second barcode fragment (or a further barcode fragment), such as those described above or anywhere else herein. In some embodiments, the set of barcode fragments comprises a third barcode fragment, such as those described above or anywhere else herein. The set of barcode fragments fused within an N-terminal XTEN polypeptide can be referred to as an N-terminal set of barcodes ("an N-terminal set"). The set of barcode fragments fused within a C-terminal XTEN polypeptide can be referred to as a C-terminal set of barcodes ("a C-terminal set"). In some embodiments, the N-terminal set comprises a first barcode fragment and a second barcode fragment. In some embodiments, the N-terminal set further comprises a third barcode fragment. In some embodiments, the C-terminal set comprises a first barcode fragment and a second barcode fragment. In some embodiments, the C-terminal set further comprises a third barcode fragment. In some embodiments, the second barcode fragment is located N-terminal to the first barcode fragment of the same set. In some embodiments, the second barcode fragment is located C-terminal to the first barcode fragment of the same set. In some embodiments, the third barcode fragment is located N-terminal to both the first and second barcode fragments. In some embodiments, the third barcode fragment is located C-terminal to both the first and second barcode fragments. In some embodiments, the third barcode fragment is located between the first and second barcode fragments. In some embodiments, the polypeptide comprises a set of barcode fragments that includes a first barcode fragment, a further (second) barcode fragment, and at least one additional barcode fragment, wherein each barcode fragment of the set of barcode fragments is a portion of the second XTEN polypeptide and differs in sequence and molecular weight from all other peptides fragments that are releasable from the polypeptide upon complete digestion of the polypeptide by the protease.

Exemplary Barcoded Xten

Amino acid sequences of 13 exemplary barcoded XTENs, containing one barcode (e.g., SEQ ID NOs: 8002-8003, 8005-8009, and 8013), or two barcodes (e.g., SEQ ID NOs: 8001, 8004, 8010, and 8012), or three barcodes (e.g., SEQ ID NO: 8011), are illustrated in Table 3a. Among these 13 exemplary barcoded XTEN polypeptides, six (SEQ ID NOs: 8001-8003, 8008-8009, and 8011) can be fused to a biologically-active protein at the C-terminal of the biologically-active protein, and seven (SEQ ID NOs: 8004-8007, 8010, and 8012-8013) can be fused at the N-terminal of the biologically-active protein. In some embodiments, the XTEN polypeptide has at least 90%, at least 92%, at least 95%, at least 98%, at least 99% or 100% sequence identity to a sequence selected from SEQ ID NOs: 8001-8019 in Table 3a.

TABLE 3a

Exemplary Barcoded XTENs

| SEQ ID NO. | XTEN Type | # of Barcode(s) | Amino Acid Sequence | Total # of AAs |
|---|---|---|---|---|
| 8001 | C-terminal XTEN | 2 | PGSPAGSPTSTEEGTSESATPESGPGTSTEPSEGSAPGSPAGS PTSTEEGTSTEPSEGSAPGTSTEPSEGSAPGTSESATPESGPG SEPATSGSETPGSEPATSGSETPGSPAGSPTSTEEGTSESATP ESGPGTSTEPSEGSAPGTSTEPSEGSAPGSPAGSPTSTEEGTS TEPSEGSAPGTSTEPSEGSAPGTSESATPESGPGTSTEPSEGS APGTSESATPESGPGSEPATSGSETPGTSTEPSEGSAPGTSTE PSEGSAPGTSESATPESGPGTSESATPESGPGSPAGSPTSTEE GTSESATPESGPGSEPATSGSETPGTSESATPESGPGTSTEPS EGSAPGTSTEPSEGSAPGTSTEPSEGSAPGTSTEPSEGSAPGT STEPSEGSAPGTSTEPSEGSAPGSPAGSPTSTEEGTSTEPSEG SAPGTSESATPESGPGSEPATSGSETPGTSESATPESGPGSEP ATSGSETPGTSESATPESGPGTSTEPSEGSAPGTSESATPESG PGSPAGSPTSTEEGSPAGSPTSTEEGSPAGSPTSTEEGTSESA TPESGPGTSTEPSEGSAPGTSESATPESGPGSEPATSGSETPG | 864 |

TABLE 3a-continued

Exemplary Barcoded XTENs

| SEQ ID NO. | XTEN Type | # of Barcode(s) | Amino Acid Sequence | Total # of AAs |
|---|---|---|---|---|
| | | | TSESATPESGPGSEPATSGSETPGTSESATPESGPGTSTEPSE<br>GSAPGSPAGSPTSTEEGTSESATPESGPGSEPATSGSETPGTS<br>ESATPESGPGSPAGSPTSTEEGSPAGSPTSTEEGTSTEPSEGS<br>APGTSESATPESGPGTSESATPESGPGftabTSESATPESGPGS<br>E**PATSGPTE**SGSEPATSGSETPGSPAGSPTSTEEGTSTEPSE<br>**GSAPGTE**STPSEGSAPGSEPATSGSETPGTSESATPESGPGT<br>STEPSEGSAPGEPEA | |
| 8002 | C-terminal XTEN | 1 | PGSPAGSPTSTEEGTSESATPESGPGTSTEPSEGSAPGSPAGS<br>PTSTEEGTSTEPSEGSAPGTSTEPSEGSAPGTSESATPESGPG<br>SEPATSGSETPGSEPATSGSETPGSPAGSPTSTEEGTSESATP<br>ESGPGTSTEPSEGSAPGTSTEPSEGSAPGSPAGSPTSTEEGTS<br>TEPSEGSAPGTSTEPSEGSAPGTSESATPESGPGTSTEPSEGS<br>APGTSESATPESGPGSEPATSGSETPGTSTEPSEGSAPGTSTE<br>PSEGSAPGTSESATPESGPGTSESATPESGPGSPAGSPTSTEE<br>GTSESATPESGPGSEPATSGSETPGTSESATPESGPGTSTEPS<br>EGSAPGTSTEPSEGSAPGTSTEPSEGSAPGTSTEPSEGSAPGT<br>STEPSEGSAPGTSTEPSEGSAPGSPAGSPTSTEEGTSTEPSEG<br>SAPGTSESATPESGPGSEPATSGSETPGTSESATPESGPGSEP<br>ATSGSETPGTSESATPESGPGTSTEPSEGSAPGTSESATPESG<br>PGSPAGSPTSTEEGSPAGSPTSTEEGSPAGSPTSTEEGTSESA<br>TPESGPGTSTEPSEGSAPGTSESATPESGPGSEPATSGSETPG<br>TSESATPESGPGSEPATSGSETPGTSESATPESGPGTSTEPSE<br>GSAPGSPAGSPTSTEEGTSESATPESGPGSEPATSGSETPGTS<br>ESATPESGPGSPAGSPTSTEEGSPAGSPTSTEEGTSTEPSEGS<br>APGTSESATPESGPGTSESATPESGPGTSESATPESGPGSE**PA**<br>**TSGPTE**SGSEPATSGSETPGSPAGSPTSTEEGTSTEPSEGSAP<br>GTSTEPSEGSAPGSEPATSGSETPGTSESATPESGPGTSTEPS<br>EGSAPGEPEA | 864 |
| 8003 | C-terminal XTEN | 1 | PGSPAGSPTSTEEGTSESATPESGPGTSTEPSEGSAPGSPAGS<br>PTSTEEGTSTEPSEGSAPGTSTEPSEGSAPGTSESATPESGPG<br>SEPATSGSETPGSEPATSGSETPGSPAGSPTSTEEGTSESATP<br>ESGPGTSTEPSEGSAPGTSTEPSEGSAPGSPAGSPTSTEEGTS<br>TEPSEGSAPGTSTEPSEGSAPGTSESATPESGPGTSTEPSEGS<br>APGTSESATPESGPGSEPATSGSETPGTSTEPSEGSAPGTSTE<br>PSEGSAPGTSESATPESGPGTSESATPESGPGSPAGSPTSTEE<br>GTSESATPESGPGSEPATSGSETPGTSESATPESGPGTSTEPS<br>EGSAPGTSTEPSEGSAPGTSTEPSEGSAPGTSTEPSEGSAPGT<br>STEPSEGSAPGTSTEPSEGSAPGSPAGSPTSTEEGTSTEPSEG<br>SAPGTSESATPESGPGSEPATSGSETPGTSESATPESGPGSEP<br>ATSGSETPGTSESATPESGPGTSTEPSEGSAPGTSESATPESG<br>PGSPAGSPTSTEEGSPAGSPTSTEEGSPAGSPTSTEEGTSESA<br>TPESGPGTSTEPSEGSAPGTSESATPESGPGSEPATSGSETPG<br>TSESATPESGPGSEPATSGSETPGTSESATPESGPGTSTEPSE<br>GSAPGSPAGSPTSTEEGTSESATPESGPGSEPATSGSETPGTS<br>ESATPESGPGSPAGSPTSTEEGSPAGSPTSTEEGTSTEPSEGS<br>APGTSESATPESGPGTSESATPESGPGTSESATPESGPGSEPA<br>TSGSETPGSEPATSGSETPGSPAGSPTSTEEGTSTEPSE**GSAP**<br>**GTE**STPSEGSAPGSEPATSGSETPGTSESATPESGPGTSTEPS<br>EGSAPGEPEA | 864 |
| 8004 | N-terminal XTEN | 2 | ASSPAGSPTSTESGTSESATPESGPGTETEPSEGSAPGTSESA<br>TPESGPGSEPATSGSETPGTSESATPE**SGPGSTPAE**SGSETP<br>GTSESATPESGPGTSTEPSEGSAPGSPAGSPTSTEEGTSESAT<br>PESGPGE**SPATSGSTPE**GTSESATPESGPGSPAGSPTSTEEGS<br>PAGSPTSTEEGTSTEPSEGSAPGTSESATPESGPGTSESATPE<br>SGPGTSESATPESGPGSEPATSGSETPGSEPATSGSETPGSPA<br>GSPTSTEEGTSTEPSEGSAPGTSTEPSEGSAPGGSAP | 288 |
| 8005 | N-terminal XTEN | 1 | ASSPAGSPTSTESGTSESATPESGPGTSTEPSEGSAPGTSESA<br>TPESGPGSEPATSGSETPGTSESATPESGPGSEPATSGSETPG<br>TSESATPESGPGTSTEPSEGSAPGSPAGSPTSTEEGTSESATP<br>ESGPGE**SPATSGSTPE**GTSESATPESGPGSPAGSPTSTEEGSP<br>AGSPTSTEEGTSTEPSEGSAPGTSESATPESGPGTSESATPES<br>GPGTSESATPESGPGSEPATSGSETPGSEPATSGSETPGSPAG<br>SPTSTEEGTSTEPSEGSAPGTSTEPSEGSAPGGSAP | 288 |
| 8006 | N-terminal XTEN | 1 | ASSPAGSPTSTESGTSESATPESGPGTSTEPSEGSAPGTSESA<br>TPESGPGSEPATSGSETPGTSESATPE**SGPGSTPAE**SGSETP<br>GTSESATPESGPGTSTEPSEGSAPGSPAGSPTSTEEGTSESAT<br>PESGPGEEPATSGSTPEGTSESATPESGPGSPAGSPTSTEEGS<br>PAGSPTSTEEGTSTEPSEGSAPGTSESATPESGPGTSESATPE<br>SGPGTSESATPESGPGSEPATSGSETPGSEPATSGSETPGSPA<br>GSPTSTEEGTSTEPSEGSAPGTSTEPSEGSAPGGSAP | 288 |

TABLE 3a-continued

| Exemplary Barcoded XTENs | | | | |
|---|---|---|---|---|
| SEQ ID NO. | XTEN Type | # of Barcode(s) | Amino Acid Sequence | Total # of AAs |
| 8007 | N-terminal XTEN | 1 | ASSPAGSPTSTESGTSESATPESGPGTSTEPSEGSAPGTSESA<br>TPESGPGSEPATSGSETPGTSESATPE**SGPGSTPAE**SGSETP<br>GTSESATPESGPGTSTEPSEGSAPGSPAGSPTSTEEGTSESAT<br>PESGPGSEPATSGSETPGTSESATPESGPGSPAGSPTSTEEGS<br>PAGSPTSTEEGTSTEPSEGSAPGTSESATPESGPGTSESATPE<br>SGPGTSESATPESGPGSEPATSGSETPGSEPATSGSETPGSPA<br>GSPTSTEEGTSTEPSEGSAPGTSTEPSEGSAPGGSAP | 288 |
| 8008 | C-terminal XTEN | 1 | PGSPAGSPTSTEEGTSESATPESGPGTSTEPSEGSAPGSPAGS<br>PTSTEEGTSTEPSEGSAPGTSTEPSEGSAPGTSESATPESGPG<br>SEPATSGSETPGSEPATSGSETPGSPAGSPTSTEEGTSESATP<br>ESGPGTSTEPSEGSAPGTSTEPSEGSAPGSPAGSPTSTEEGTS<br>TEPSEGSAPGTSTEPSEGSAPGTSESATPESGPGTSTEPSEGS<br>APGTSESATPESGPGSEPATSGSETPGTSTEPSEGSAPGTSTE<br>PSEGSAPGTSESATPESGPGTSESATPESGPGSPAGSPTSTEE<br>GTSESATPESGPGSEPATSGSETPGTSESATPESGPGTSTEPS<br>EGSAPGTSTEPSEGSAPGTSTEPSEGSAPGTSTEPSEGSAPGT<br>STEPSEGSAPGTSTEPSEGSAPGSPAGSPTSTEEGTSTEPSEG<br>SAPGTSESATPESGPGSEPATSGSETPGTSESATPESGPGSEP<br>ATSGSETPGTSESATPESGPGTSTEPSEGSAPGTSESATPESG<br>PGSPAGSPTSTEEGSPAGSPTSTEEGSPAGSPTSTEEGTSESA<br>TPESGPGTSTEPSEGSAPGTSESATPESGPGSEPATSGSETPG<br>TSESATPESGPGSEPATSGSETPGTSESATPESGPGTSTEPSE<br>GSAPGSPAGSPTSTEEGTSESATPESGPGSEPATSGSETPGTS<br>ESATPESGPGSPAGSPTSTEEGSPAGSPTSTEEGTSTEPSEGS<br>APGTSESATPESGPGTSESATPESGPGTSESATPESGPGSEPA<br>TSGSETPGSEPATSGSETPGSPAGSPTSTEEGTSTEPSE**GSAP**<br>**GTE**STPSEGSAPGSEPATSGSETPGTSESATPESGPGTSTEPS<br>EGSAPG | 864 |
| 8009 | C-terminal XTEN | 1 | PGSPAGSPTSTEEGTSESATPESGPGSEPATSGSETPGTSESA<br>TPESGPGTSTEPSEGSAPGTSTEPSEGSAPGTSTEPSEGSAPG<br>TSTEPSEGSAPGTSTEPSEGSAPGTSTEPSEGSAPGSPAGSPT<br>STEEGTSTEPSEGSAPGTSESATPESGPGSEPATSGSETPGTS<br>ESATPESGPGSEPATSGSETPGTSESATPESGPGTSTEPSEGS<br>APGTSESATPESGPGSPAGSPTSTEEGSPAGSPTSTEEGSPAG<br>SPTSTEEGTSESATPESGPGTSTEPSEGSAPGTSESATPESGP<br>GSEPATSGSETPGTSESATPESGPGSEPATSGSETPGTSESAT<br>PESGPGTSTEPSEGSAPGSPAGSPTSTEEGTSESATPESGPGS<br>EPATSGSETPGTSESATPESGPGSPAGSPTSTEEGSPAGSPTS<br>TEEGTSTEPSEGSAPGTSESATPESGPGTSESATPESGPGTSE<br>SATPESGPGSEPATSGSETPGSEPATSGSETPGSPAGSPTSTE<br>EGTSTEPSE**GSAPGTE**STPSEGSAPGSEPATSGSETPGTSES<br>ATPESGPGTSTEPSEGSAPG | 576 |
| 8010 | N-terminal XTEN | 2 | SAGSPGSPAGSPTSTEEGTSESATPESGPGTSTEPSEGSAPGS<br>PAGSPTSTEEGTSTEPSEGSAPGTSTEPSEGSAPGTSESATPE<br>**SGPGSTPAE**SGSETPGSEPATSGSETPGSPAGSPTSTEEGTS<br>ESATPESGPGTSTEPSEGSAPGTSTEPSEGSAPGSPAGSPTST<br>EEGTSTEPSEGSAPGTSTEPSEGSAPGTSESATPESGPGTSTE<br>PSEGSAPGTSESATPESGPGSE**PATSGSTE**TPGTSTEPSEGSA<br>PGTSTEPSEGSAPGTSESATPESGPGTSESATPESGPGSPAGS<br>PTSTEEGTSESATPESGPGSEPATSGSETPGTSESATPESGPG<br>TSTEPSEGSAPGTSTEPSEGSAPGTSTEPSEGSAPGTSTEPSE<br>GSAPGTSTEPSEGSAPGTSTEPSEGSAPGSPAGSPTSTEEGTS<br>TEPSEGSAPGTSESATPESGPGSEPATSGSETPGTSESATPES<br>GPGSEPATSGSETPGTSESATPESGPGTSTEPSEGSAPGTSES<br>ATPESGPGSPAGSPTSTEEGSPAGSPTSTEEGSPAGSPTSTEE<br>GTSESATPESGPGTSTEPSEGSAPGTSESATPESGPGSEPATS<br>GSETPGTSESATPESGPGSEPATSGSETPGTSESATPESGPGT<br>STEPSEGSAPGSPAGSPTSTEEGTSESATPESGPGSEPATSGS<br>ETPGTSESATPESGPGSPAGSPTSTEEGSPAGSPTSTEEGTST<br>EPSEGSAPGTSESATPESGPGTSESATPESGPGTSESATPESG<br>PGSEPATSGSETPGSEPATSGSETPGSPAGSPTSTEEGTSTEP<br>SEGSAPGTSTEPSEGSAPGSEPATSGSETPGTSESATPESGPG<br>TSTEPSEGSAPGSPAGSPTSTEEGTSESATPESGPGTSTEPSE<br>GSAPGSPAGSPTSTEEGTSTEPSEGSAPGTSTEPSEGSAPGTS<br>ESATPESGPGSEPATSGSETPGSEPATSGSETPGSPAGSPTST<br>EEGTSESATPESGPGTSTEPSEGSAPGTSTEPSEGSAPGSPAG<br>SPTSTEEGTSTEPSEGSAPGTSTEPSEGSAPGTSESATPESGP<br>GTSTEPSEGSAPGTSESATPESGPGSEPATSGSETPGTSTEPS<br>EGSAPGTSTEPSEGSAPGTSESATPESGPGTESAS | 1152 |

TABLE 3a-continued

| Exemplary Barcoded XTENs | | | | |
|---|---|---|---|---|
| SEQ ID NO. | XTEN Type | # of Barcode(s) | Amino Acid Sequence | Total # of AAs |
| 8011 | C-terminal XTEN | 3 | SAGSPGSPAGSPTSTEEGTSESATPESGPGTSTEPSEGSAPGS<br>PAGSPTSTEEGTSTEPSEGSAPGTSTEPSEGSAPGTSESATPE<br>SGPGSEPATSGSETPGSEPATSGSETPGSPAGSPTSTEEGTSE<br>SATPESGPGTSTEPSEGSAPGTSTEPSEGSAPGSPAGSPTSTE<br>EGTSTEPSEGSAPGTSTEPSEGSAPGTSESATPESGPGTSTEP<br>SEGSAPGTSESATPESGPGSEPATSGSETPGTSTEPSEGSAPG<br>TSTEPSEGSAPGTSESATPESGPGTSESATPESGPGSPAGSPT<br>STEEGTSESATPESGPGSEPATSGSETPGTSESATPESGPGTS<br>TEPSEGSAPGTSTEPSEGSAPGTSTEPSEGSAPGTSTEPSEGS<br>APGTSTEPSEGSAPGTSTEPSEGSAPGSPAGSPTSTEEGTSTE<br>PSEGSAPGTSESATPESGPGSEPATSGSETPGTSESATPESGP<br>GSEPATSGSETPGTSESATPESGPGTSTEPSEGSAPGTSESAT<br>PESGPGSPAGSPTSTEEGSPAGSPTSTEEGSPAGSPTSTEEGT<br>SESATPESGPGTSTEPSEGSAPGTSESATPESGPGSEPATSGS<br>ETPGTSESATPESGPGSEPATSGSETPGTSESATPESGPGTST<br>EPSEGSAPGSPAGSPTSTEEGTSESATPESGPGSEPATSGSET<br>PGTSESATPESGPGSPAGSPTSTEEGSPAGSPTSTEEGTSTEP<br>SEGSAPGTSESATPESGPGTSESATPESGPGTSESATPESGPG<br>SEPATSGSETPGSEPATSGSETPGSPAGSPTSTEEGTSTEPSE<br>GSAPGTSTEPSEGSAPGSEPATSGSETPGTSESATPESGPGTS<br>TEPSEGSAPGSPAGSPTSTEEGTSESATPESGPGTSTEPSEGS<br>APGSPAGSPTSTEEGTSTEPSEGSAPGTSTEPSEGSAPGTSES<br>ATPESGPGSEPATSGSETPGSE**PATSGSTE**TPGSPAGSPTSTE<br>EGTSESATPESGPGTSTEPSEGSAPGTSTEPSEGSAPGSPAGS<br>PTSTEEGTSTEPSE**GSAPGTATE**SPEGSAPGTSESATPESGP<br>GTSTEPSE**GSAPGTSAE**SATPESGPGSEPATSGSETPGTSTE<br>PSEGSAPGTSTEPSEGSAPGTSESATPESGPGTESAS | 1152 |
| 8012 | N-terminal XTEN | 2 | GSPAGSPTSTEEGTSESATPESGPGTSTEPSEGSAPGSPAGSP<br>TSTEEGTSTEPSEGSAPGTSTEPSE**GSAPATSE**SATPESGPGS<br>EPATSGSETPGSEPATSGSETPGSPAGSPTSTEEGTSE**SASPE**<br>SGPGTSTEPSEGSAPGTSTEPSEGSAPGSPAGSPTSTEEGTST<br>EPSEGSAPGTSTEPSEGSAPGTSESATPESGPGTSTEPSEGSA<br>PGTSESATPESGPGSEPATSGSETPGTSTEPSEGSAPGTSTEP<br>SEGSAPGTSESATPESGPGTSESATPESGPGSPAGSPTSTEEG<br>TSESATPESGPGSEPATSGSETPGTSESATPESGPGTSTEPSE<br>GSAPGTSTEPSEGSAPGTSTEPSEGSAPGTSTEPSEGSAPGTS<br>TEPSEGSAPGTSTEPSEGSAPGSPAGSPTSTEEGTSTEPSEGS<br>APGTSESATPESGPGSEPATSGSETPGTSESATPESGPGSEPA<br>TSGSETPGTSESATPESGPGTSTEPSEGSAPGTSESATPESGP<br>GSPAGSPTSTEEGSPAGSPTSTEEGSPAGSPTSTEEGTSESAT<br>PESGPGTSTEPSEGSAPGTSESATPESGPGSEPATSGSETPGT<br>SESATPESGPGSEPATSGSETPGTSESATPESGPGTSTEPSEG<br>SAPGSPAGSPTSTEEGTSESATPESGPGSEPATSGSETPGTSE<br>SATPESGPGSPAGSPTSTEEGSPAGSPTSTEEGTSTEPSEGSA<br>PGTSESATPESGPGTSESATPESGPGTSESATPESGPGSEPAT<br>SGSETPGSEPATSGSETPGSPAGSPTSTEEGTSTEPSEGSAPG<br>TSTEPSEGSAPGSEPATSGSETPGTSESATPESGPGTSTEPSE<br>GSAP | 864 |
| 8013 | N-terminal XTEN | 1 | GSPAGSPTSTEEGTSESATPESGPGTSTEPSEGSAPGSPAGSP<br>TSTEEGTSTEPSEGSAPGTSTEPSEGSAPGTSESATPESGPGS<br>E**SATSGSE**TPGSEPATSGSETPGSPAGSPTSTEEGTSESATPE<br>SGPGTSTEPSEGSAPGTSTEPSEGSAPGSPAGSPTSTEEGTST<br>EPSEGSAPGTSTEPSEGSAPGTSESATPESGPGTSTEPSEGSA<br>PGTSESATPESGPGSEPATSGSETPGTSTEPSEGSAPGTSTEP<br>SEGSAPGTSESATPESGPGTSESATPESGPGSPAGSPTSTEEG<br>TSESATPESGPGSEPATSGSETPGTSESATPESGPGTSTEPSE<br>GSAPGTSTEPSEGSAPGTSTEPSEGSAPGTSTEPSEGSAPGTS<br>TEPSEGSAPGTSTEPSEGSAPGSPAGSPTSTEEGTSTEPSEGS<br>APGTSESATPESGPGSEPATSGSETPGTSESATPESGPGSEPA<br>TSGSETPGTSESATPESGPGTSTEPSEGSAPGTSESATPESGP<br>GSPAGSPTSTEEGSPAGSPTSTEEGSPAGSPTSTEEGTSESAT<br>PESGPGTSTEPSEGSAPGTSESATPESGPGSEPATSGSETPGT<br>SESATPESGPGSEPATSGSETPGTSESATPESGPGTSTEPSEG<br>SAPGSPAGSPTSTEEGTSESATPESGPGSEPATSGSETPGTSE<br>SATPESGPGSPAGSPTSTEEGSPAGSPTSTEEGTSTEPSEGSA<br>PGTSESATPESGPGTSESATPESGPGTSESATPESGPGSEPAT<br>SGSETPGSEPATSGSETPGSPAGSPTSTEEGTSTEPSEGSAPG<br>TSTEPSEGSAPGSEPATSGSETPGTSESATPESGPGTSTEPSE<br>GSAP | 864 |

TABLE 3a-continued

Exemplary Barcoded XTENs

| SEQ ID NO. | XTEN Type | # of Barcode(s) | Amino Acid Sequence | Total # of AAs |
|---|---|---|---|---|
| 8014 | N-terminal XTEN (with His-tag) | 1 | SPAGSPTSTESGTSESATPESGPGTSTEPSEGSAPGTSESATP<br>ESGPGSEPATSGSETPGTSESATPE**SGPGSTPAESGSE**TPGT<br>SESATPESGPGTSTEPSEGSAPGSPAGSPTSTEEGTSESATPE<br>SGPGSEPATSGSETPGTSESATPESGPGSPAGSPTSTEEGSPA<br>GSPTSTEEGTSTEPSEGSAPGTSESATPESGPGTSESATPESG<br>PGTSESATPESGPGSEPATSGSETPGSEPATSGSETPGSPAGS<br>PTSTEEGTSTEPSEGSAPGTSTEPSEGSAPGGSAP | 292 |
| 8015 | C-terminal XTEN | 1 | PGSPAGSPTSTEEGTSESATPESGPGSEPATSGSETPGTSESA<br>TPESGPGTSTEPSEGSAPGTSTEPSEGSAPGTSTEPSEGSAPG<br>TSTEPSEGSAPGTSTEPSEGSAPGTSTEPSEGSAPGSPAGSPT<br>STEEGTSTEPSEGSAPGTSESATPESGPGSEPATSGSETPGTS<br>ESATPESGPGSEPATSGSETPGTSESATPESGPGTSTEPSEGS<br>APGTSESATPESGPGSPAGSPTSTEEGSPAGSPTSTEEGSPAG<br>SPTSTEEGTSESATPESGPGTSTEPSEGSAPGTSESATPESGP<br>GSEPATSGSETPGTSESATPESGPGSEPATSGSETPGTSESAT<br>PESGPGTSTEPSEGSAPGSPAGSPTSTEEGTSESATPESGPGS<br>EPATSGSETPGTSESATPESGPGSPAGSPTSTEEGSPAGSPTS<br>TEEGTSTEPSEGSAPGTSESATPESGPGTSESATPESGPGTSE<br>SATPESGPGSEPATSGSETPGSEPATSGSETPGSPAGSPTSTE<br>EGTSTEPSE**GSAPGTE**STPSEGSAPGSEPATSGSETPGTSES<br>ATPESGPGTSTEPSEGSAPGEPEA | 582 |
| 8016 | C-terminal XTEN | 1 | TPESGPGTSESATPESGPGSPAGSPTSTEEGTSESATPESGPG<br>SEPATSGSETPGTSESATPESGPGTSTEPSEGSAPGTSTEPSE<br>GSAPGTSTEPSEGSAPGTSTEPSEGSAPGTSTEPSEGSAPGTS<br>TEPSEGSAPGSPAGSPTSTEEGTSTEPSEGSAPGTSESATPES<br>GPGSEPATSGSETPGTSESATPESGPGSEPATSGSETPGTSES<br>ATPESGPGTSTEPSEGSAPGTSESATPESGPGSPAGSPTSTEE<br>GSPAGSPTSTEEGSPAGSPTSTEEGTSESATPESGPGTSTEPS<br>EGSAPGTSESATPESGPGSEPATSGSETPGTSESATPESGPGS<br>EPATSGSETPGTSESATPESGPGTSTEPSEGSAPGSPAGSPTS<br>TEEGTSESATPESGPGSEPATSGSETPGTSESATPESGPGSPA<br>GSPTSTEEGSPAGSPTSTEEGTSTEPSEGSAPGTSESATPESG<br>PGTSESATPESGPGTSESATPESGPGSEPATSGSETPGSE**SAT**<br>**SGSE**TPGSPAGSPTSTEEGTSTEPSEGSAPGTSTEPSEGSAPG<br>SEPATSGSETPGTSESA | 576 |
| 8017 | C-terminal XTEN | 1 | GTSTEPSEGSAPGTSESATPESGPGSEPATSGSETPGSEPATS<br>GSETPGSPAGSPTSTEEGTSESATPESGPGTSTEPSEGSAPGT<br>STEPSEGSAPGSPAGSPTSTEEGTSTEPSEGSAPGTSTEPSEG<br>SAPGTSESATPESGPGTSTEPSEGSAPGTSESATPESGPGSEP<br>ATSGSETPGTSTEPSEGSAPGTSTEPSEGSAPGTSESATPESG<br>PGTSESATPESGPGSPAGSPTSTEEGTSESATPESGPGSEPAT<br>SGSETPGTSESATPESGPGTSTEPSEGSAPGTSTEPSEGSAPG<br>TSTEPSEGSAPGTSTEPSEGSAPGTSTEPSEGSAPGTSTEPSE<br>GSAPGSPAGSPTSTEEGTSTEPSEGSAPGTSESATPESGPGSE<br>PATSGSETPGTSESATPESGPGSEPATSGSETPGTSESATPES<br>GPGTSTEPSEGSAPGTSE**SASPE**SGPGSPAGSPTSTEEGSPAG<br>SPTSTEEGSPAGSPTSTEEGTSESATPESGPGTSTEPSEGSAP<br>GTSESATPESGPGSEPATSGSETPGTSESATPESGPGSEPATS<br>GSETPGTSESATPESGP | 576 |
| 8018 | C-terminal XTEN | 1 | GSETPGSPAGSPTSTEEGTSESATPESGPGTSTEPSEGSAPGT<br>STEPSEGSAPGSPAGSPTSTEEGTSTEPSEGSAPGTSTEPSEG<br>SAPGTSESATPESGPGTSTEPSEGSAPGTSESATPESGPGSEP<br>ATSGSETPGTSTEPSEGSAPGTSTEPSEGSAPGTSESATPESG<br>PGTSESATPESGPGSPAGSPTSTEEGTSESATPESGPGSEPAT<br>SGSETPGTSESATPESGPGTSTEPSEGSAPGTSTEPSEGSAPG<br>TSTEPSEGSAPGTSTEPSEGSAPGTSTEPSEGSAPGTSTEPSE<br>GSAPGSPAGSPTSTEEGTSTEPSEGSAPGTSESATPESGPGSE<br>PATSGSETPGTSESATPESGPGSEPATSGSETPGTSESATPES<br>GPGTSTEPSEGSAPGTSESATPESGPGSPAGSPTSTEEGSPAG<br>SPTSTEEGSPAGSPTSTEEGTSESATPESGPGTSTEPSEGSAP<br>GTSESATPESGPGSE**PATSGSTE**TGTSESATPESGPGSEPAT<br>SGSETPGTSESATPESGPGTSTEPSEGSAPGSPAGSPTSTEEG<br>TSESATPESGPGSEPATS | 576 |
| 8019 | C-terminal XTEN | 1 | EGSAPGTSTEPSEGSAPGTSESATPESGPGTSTEPSEGSAPGT<br>SESATPESGPGSEPATSGSETPGTSTEPSEGSAPGTSTEPSEG<br>SAPGTSESATPESGPGTSESATPESGPGSPAGSPTSTEEGTSE<br>SATPESGPGSEPATSGSETPGTSESATPESGPGTSTEPSEGSA<br>PGTSTEPSEGSAPGTSTEPSEGSAPGTSTEPSEGSAPGTSTEP<br>SEGSAPGTSTEPSEGSAPGSPAGSPTSTEEGTSTEPSEGSAPG | 576 |

TABLE 3a-continued

Exemplary Barcoded XTENs

| SEQ ID NO. | XTEN Type | # of Barcode(s) | Amino Acid Sequence | Total # of AAs |
|---|---|---|---|---|
| | | | TSESATPESGPGSEPATSGSETPGTSESATPESGPGSEPATSG<br>SETPGTSESATPESGPGTSTEPSEGSAPGTSESATPESGPGSP<br>AGSPTSTEEGSPAGSPTSTEEGSPAGSPTSTEEGTSESATPES<br>GPGTSTEPSEGSAPGTSESATPESGPGSEPATSGSETPGTSES<br>ATPESGPGSEPATSGSETPGTSE**SASPE**SGPGTSTEPSEGSAP<br>GSPAGSPTSTEEGTSESATPESGPGSEPATSGSETPGTSESAT<br>PESGPGSPAGSPTSTEEGSPAGSPTSTEEGTSTEPSEGSAPGT<br>SESATPESGPGTSESAT | |

In some embodiments, a barcoded XTEN polypeptide can be obtained by making one or more mutations to a general-purpose XTEN polypeptide, such as any listed in Table 3b, according to one or more of the following criteria: to minimize the sequence change in the XTEN polypeptide, to minimize the amino acid composition change in the XTEN polypeptide, to substantially maintain the net charge of the XTEN polypeptide, to substantially maintain (or improve) low immunogenicity of the XTEN polypeptide, and to substantially maintain (or improve) the pharmacokinetic properties of the XTEN polypeptide. In some embodiments, the XTEN polypeptide amino acid sequence has at least 90%, at least 92%, at least 95%, at least 98%, at least 99%, or 100% sequence identity to any one of SEQ ID NOs: 676-734 listed in Table 3b. In some embodiments, the XTEN sequence, having at least 90% (e.g., at least 92%, at least 95%, at least 98%, or at least 99%) but less than 100% sequence identity to any of SEQ ID NOs: 676-734 listed in Table 3b, is obtained by one or more mutations (e.g., less than 10, less than 8, less than 6, less than 5, less than 4, less than 3, less than 2 mutations) of the corresponding sequence from Table 3b. In some embodiments, the one or more mutations comprise deletion of a glutamic acid residue, insertion of a glutamic acid residue, substitution of a glutamic acid residue, or substitution for a glutamic acid residue, or any combination thereof. In some embodiments, where the XTEN polypeptide amino acid sequence differs from, but has at least 90% (e.g., at least 92%, at least 95%, at least 98%, or at least 99%) sequence identity to, any one of SEQ ID NOs: 676-734 listed in Table 3b, at least 80%, at least 90%, at least 95%, at least 97%, or about 100% of the difference between the XTEN polypeptide amino acid sequence and the corresponding sequence of Table 3b involve deletion of a glutamic acid residue, insertion of a glutamic acid residue, substitution of a glutamic acid residue, or substitution for a glutamic acid residue, or any combination thereof. In some such embodiments, at least 80%, at least 90%, at least 95%, at least 97%, or about 100% of the difference between the XTEN polypeptide amino acid sequence and the corresponding sequence of Table 3b involve a substitution of a glutamic acid residue, or a substitution for a glutamic acid residue, or both. The term "a substitution of a first amino acid," as used herein, refers to replacement of the first amino acid residue for a second amino acid residue, resulting in the second amino acid residue taking place at the substitution position in the obtained sequence. For example, "a substitution of glutamic acid" refers to replacement of the glutamic acid (E) residue for a non-glutamic acid residue (e.g., serine (S)). The term "a substitution for a first amino acid," as used herein, refers to replacement of a second amino acid residue for the first amino acid residue, resulting in the first amino acid residue taking place at the substitution position in the obtained sequence. For example, "a substitution for glutamic acid" refers to replacement of a non-glutamic acid residue (e.g., serine (S)) for a glutamic acid residue.

TABLE 3b

Exemplary General-Purpose XTENs That for Engineering into Barcoded XTEN(s)

| SEQ ID NO | XTEN Name | Amino Acid Sequence |
|---|---|---|
| 676 | AE144 | GSEPATSGSETPGTSESATPESGPGSEPATSGSETPGSPAGSPTSTEEGTSTEPSEGSAPGSEP<br>ATSGSETPGSEPATSGSETPGSEPATSGSETPGTSTEPSEGSAPGTSESATPESGPGSEPATS<br>GSETPGTSTEPSEGSAP |
| 677 | AE144_1A | SPAGSPTSTEEGTSESATPESGPGTSTEPSEGSAPGSPAGSPTSTEEGTSTEPSEGSAPGTSTE<br>PSEGSAPGTSESATPESGPGSEPATSGSETPGSEPATSGSETPGSPAGSPTSTEEGTSESATPE<br>SGPGTSTEPSEGSAPG |
| 678 | AE144_2A | TSTEPSEGSAPGSPAGSPTSTEEGTSTEPSEGSAPGTSTEPSEGSAPGTSESATPESGPGTSTE<br>PSEGSAPGTSESATPESGPGSEPATSGSETPGTSTEPSEGSAPGTSTEPSEGSAPGTSESATPE<br>SGPGTSESATPESGPG |
| 679 | AE144_2B | TSTEPSEGSAPGSPAGSPTSTEEGTSTEPSEGSAPGTSTEPSEGSAPGTSESATPESGPGTSTE<br>PSEGSAPGTSESATPESGPGSEPATSGSETPGTSTEPSEGSAPGTSTEPSEGSAPGTSESATPE<br>SGPGTSESATPESGPG |
| 680 | AE144_3A | SPAGSPTSTEEGTSESATPESGPGSEPATSGSETPGTSESATPESGPGTSTEPSEGSAPGTSTE<br>PSEGSAPGTSTEPSEGSAPGTSTEPSEGSAPGTSTEPSEGSAPGTSTEPSEGSAPGSPAGSPTS<br>TEEGTSTEPSEGSAPG |

TABLE 3b-continued

Exemplary General-Purpose XTENs That for Engineering into Barcoded XTEN(s)

| SEQ ID NO | XTEN Name | Amino Acid Sequence |
|---|---|---|
| 681 | AE144_3B | SPAGSPTSTEEGTSESATPESGPGSEPATSGSETPGTSESATPESGPGTSTEPSEGSAPGTSTE<br>PSEGSAPGTSTEPSEGSAPGTSTEPSEGSAPGTSTEPSEGSAPGTSTEPSEGSAPGSPAGSPTS<br>TEEGTSTEPSEGSAPG |
| 682 | AE144_4A | TSESATPESGPGSEPATSGSETPGTSESATPESGPGSEPATSGSETPGTSESATPESGPGTSTE<br>PSEGSAPGTSESATPESGPGSPAGSPTSTEEGSPAGSPTSTEEGSPAGSPTSTEEGTSESATPE<br>SGPGTSTEPSEGSAPG |
| 683 | AE144_4B | TSESATPESGPGSEPATSGSETPGTSESATPESGPGSEPATSGSETPGTSESATPESGPGTSTE<br>PSEGSAPGTSESATPESGPGSPAGSPTSTEEGSPAGSPTSTEEGSPAGSPTSTEEGTSESATPE<br>SGPGTSTEPSEGSAPG |
| 684 | AE144_5A | TSESATPESGPGSEPATSGSETPGTSESATPESGPGSEPATSGSETPGTSESATPESGPGTSTE<br>PSEGSAPGSPAGSPTSTEEGTSESATPESGPGSEPATSGSETPGTSESATPESGPGSPAGSPTS<br>TEEGSPAGSPTSTEEG |
| 685 | AE144_6B | TSTEPSEGSAPGTSESATPESGPGTSESATPESGPGTSESATPESGPGSEPATSGSETPGSEPA<br>TSGSETPGSPAGSPTSTEEGTSTEPSEGSAPGTSTEPSEGSAPGSEPATSGSETPGTSESATPE<br>SGPGTSTEPSEGSAPG |
| 686 | AE288_1 | GTSESATPESGPGSEPATSGSETPGTSESATPESGPGSEPATSGSETPGTSESATPESGPGTS<br>TEPSEGSAPGSPAGSPTSTEEGTSESATPESGPGSEPATSGSETPGTSESATPESGPGSPAGS<br>PTSTEEGSPAGSPTSTEEGTSTEPSEGSAPGTSESATPESGPGTSESATPESGPGTSESATPES<br>GPGSEPATSGSETPGSEPATSGSETPGSPAGSPTSTEEGTSTEPSEGSAPGTSTEPSEGSAPG<br>SEPATSGSETPGTSESATPESGPGTSTEPSEGSAP |
| 687 | AE288_2 | GSPAGSPTSTEEGTSESATPESGPGSEPATSGSETPGTSESATPESGPGTSTEPSEGSAPGTS<br>TEPSEGSAPGTSTEPSEGSAPGTSTEPSEGSAPGTSTEPSEGSAPGTSTEPSEGSAPGSPAGS<br>PTSTEEGTSTEPSEGSAPGTSESATPESGPGSEPATSGSETPGTSESATPESGPGSEPATSGSE<br>TPGTSESATPESGPGTSTEPSEGSAPGTSESATPESGPGSPAGSPTSTEEGSPAGSPTSTEEGS<br>PAGSPTSTEEGTSESATPESGPGTSTEPSEGSAP |
| 688 | AE576 | GSPAGSPTSTEEGTSESATPESGPGTSTEPSEGSAPGSPAGSPTSTEEGTSTEPSEGSAPGTS<br>TEPSEGSAPGTSESATPESGPGSEPATSGSETPGSEPATSGSETPGSPAGSPTSTEEGTSESA<br>TPESGPGTSTEPSEGSAPGTSTEPSEGSAPGSPAGSPTSTEEGTSTEPSEGSAPGTSTEPSEGS<br>APGTSESATPESGPGTSTEPSEGSAPGTSESATPESGPGSEPATSGSETPGTSTEPSEGSAPG<br>TSTEPSEGSAPGTSESATPESGPGTSESATPESGPGSPAGSPTSTEEGTSESATPESGPGSEPA<br>TSGSETPGTSESATPESGPGTSTEPSEGSAPGTSTEPSEGSAPGTSTEPSEGSAPGTSTEPSEG<br>SAPGTSTEPSEGSAPGTSTEPSEGSAPGSPAGSPTSTEEGTSTEPSEGSAPGTSESATPESGP<br>GSEPATSGSETPGTSESATPESGPGSEPATSGSETPGTSESATPESGPGTSTEPSEGSAPGTS<br>ESATPESGPGSPAGSPTSTEEGSPAGSPTSTEEGSPAGSPTSTEEGTSESATPESGPGTSTEPS<br>EGSAP |
| 689 | AE624 | MAEPAGSPTSTEEGTPGSGTASSSPGSSTPSGATGSPGASPGTSSTGSPGSPAGSPTSTEEGT<br>SESATPESGPGTSTEPSEGSAPGSPAGSPTSTEEGTSTEPSEGSAPGTSTEPSEGSAPGTSESA<br>TPESGPGSEPATSGSETPGSEPATSGSETPGSPAGSPTSTEEGTSESATPESGPGTSTEPSEGS<br>APGTSTEPSEGSAPGSPAGSPTSTEEGTSTEPSEGSAPGTSTEPSEGSAPGTSESATPESGPG<br>TSTEPSEGSAPGTSESATPESGPGSEPATSGSETPGTSTEPSEGSAPGTSTEPSEGSAPGTSES<br>ATPESGPGTSESATPESGPGSPAGSPTSTEEGTSESATPESGPGSEPATSGSETPGTSESATP<br>ESGPGTSTEPSEGSAPGTSTEPSEGSAPGTSTEPSEGSAPGTSTEPSEGSAPGTSTEPSEGSAP<br>GTSTEPSEGSAPGSPAGSPTSTEEGTSTEPSEGSAPGTSESATPESGPGSEPATSGSETPGTS<br>ESATPESGPGSEPATSGSETPGTSESATPESGPGTSTEPSEGSAPGTSESATPESGPGSPAGS<br>PTSTEEGSPAGSPTSTEEGSPAGSPTSTEEGTSESATPESGPGTSTEPSEGSAP |
| 690 | AE864 | GSPAGSPTSTEEGTSESATPESGPGTSTEPSEGSAPGSPAGSPTSTEEGTSTEPSEGSAPGTS<br>TEPSEGSAPGTSESATPESGPGSEPATSGSETPGSEPATSGSETPGSPAGSPTSTEEGTSESA<br>TPESGPGTSTEPSEGSAPGTSTEPSEGSAPGSPAGSPTSTEEGTSTEPSEGSAPGTSTEPSEGS<br>APGTSESATPESGPGTSTEPSEGSAPGTSESATPESGPGSEPATSGSETPGTSTEPSEGSAPG<br>TSTEPSEGSAPGTSESATPESGPGTSESATPESGPGSPAGSPTSTEEGTSESATPESGPGSEPA<br>TSGSETPGTSESATPESGPGTSTEPSEGSAPGTSTEPSEGSAPGTSTEPSEGSAPGTSTEPSEG<br>SAPGTSTEPSEGSAPGTSTEPSEGSAPGSPAGSPTSTEEGTSTEPSEGSAPGTSESATPESGP<br>GSEPATSGSETPGTSESATPESGPGSEPATSGSETPGTSESATPESGPGTSTEPSEGSAPGTS<br>ESATPESGPGSPAGSPTSTEEGSPAGSPTSTEEGSPAGSPTSTEEGTSESATPESGPGTSTEPS<br>EGSAPGTSESATPESGPGSEPATSGSETPGTSESATPESGPGSEPATSGSETPGTSESATPES<br>GPGTSTEPSEGSAPGSPAGSPTSTEEGTSESATPESGPGSEPATSGSETPGTSESATPESGPG<br>SPAGSPTSTEEGSPAGSPTSTEEGTSTEPSEGSAPGTSESATPESGPGTSESATPESGPGTSES<br>ATPESGPGSEPATSGSETPGSEPATSGSETPGSPAGSPTSTEEGTSTEPSEGSAPGTSTEPSE<br>GSAPGSEPATSGSETPGTSESATPESGPGTSTEPSEGSAP |
| 691 | AE865 | GGSPAGSPTSTEEGTSESATPESGPGTSTEPSEGSAPGSPAGSPTSTEEGTSTEPSEGSAPGT<br>STEPSEGSAPGTSESATPESGPGSEPATSGSETPGSEPATSGSETPGSPAGSPTSTEEGTSESA<br>TPESGPGTSTEPSEGSAPGTSTEPSEGSAPGSPAGSPTSTEEGTSTEPSEGSAPGTSTEPSEGS<br>APGTSESATPESGPGTSTEPSEGSAPGTSESATPESGPGSEPATSGSETPGTSTEPSEGSAPG<br>TSTEPSEGSAPGTSESATPESGPGTSESATPESGPGSPAGSPTSTEEGTSESATPESGPGSEPA |

TABLE 3b-continued

| Exemplary General-Purpose XTENs That for Engineering into Barcoded XTEN(s) | | |
|---|---|---|
| SEQ ID NO | XTEN Name | Amino Acid Sequence |
| | | TSGSETPGTSESATPESGPGTSTEPSEGSAPGTSTEPSEGSAPGTSTEPSEGSAPGTSTEPSEG SAPGTSTEPSEGSAPGTSTEPSEGSAPGSPAGSPTSTEEGTSTEPSEGSAPGTSESATPESGP GSEPATSGSETPGTSESATPESGPGSEPATSGSETPGTSESATPESGPGTSTEPSEGSAPGTS ESATPESGPGSPAGSPTSTEEGSPAGSPTSTEEGSPAGSPTSTEEGTSESATPESGPGTSTEPS EGSAPGTSESATPESGPGSEPATSGSETPGTSESATPESGPGSEPATSGSETPGTSESATPES GPGTSTEPSEGSAPGSPAGSPTSTEEGTSESATPESGPGSEPATSGSETPGTSESATPESGPG SPAGSPTSTEEGSPAGSPTSTEEGTSTEPSEGSAPGTSESATPESGPGTSESATPESGPGTSES ATPESGPGSEPATSGSETPGSEPATSGSETPGSPAGSPTSTEEGTSTEPSEGSAPGTSTEPSE GSAPGSEPATSGSETPGTSESATPESGPGTSTEPSEGSAP |
| 692 | AE866 | PGSPAGSPTSTEEGTSESATPESGPGTSTEPSEGSAPGSPAGSPTSTEEGTSTEPSEGSAPGTS TEPSEGSAPGTSESATPESGPGSEPATSGSETPGSEPATSGSETPGSPAGSPTSTEEGTSESA TPESGPGTSTEPSEGSAPGTSTEPSEGSAPGSPAGSPTSTEEGTSTEPSEGSAPGTSTEPSEGS APGTSESATPESGPGTSTEPSEGSAPGTSESATPESGPGSEPATSGSETPGTSTEPSEGSAPG TSTEPSEGSAPGTSESATPESGPGTSESATPESGPGSPAGSPTSTEEGTSESATPESGPGSEPA TSGSETPGTSESATPESGPGTSTEPSEGSAPGTSTEPSEGSAPGTSTEPSEGSAPGTSTEPSEG SAPGTSTEPSEGSAPGTSTEPSEGSAPGSPAGSPTSTEEGTSTEPSEGSAPGTSESATPESGP GSEPATSGSETPGTSESATPESGPGSEPATSGSETPGTSESATPESGPGTSTEPSEGSAPGTS ESATPESGPGSPAGSPTSTEEGSPAGSPTSTEEGSPAGSPTSTEEGTSESATPESGPGTSTEPS EGSAPGTSESATPESGPGSEPATSGSETPGTSESATPESGPGSEPATSGSETPGTSESATPES GPGTSTEPSEGSAPGSPAGSPTSTEEGTSESATPESGPGSEPATSGSETPGTSESATPESGPG SPAGSPTSTEEGSPAGSPTSTEEGTSTEPSEGSAPGTSESATPESGPGTSESATPESGPGTSES ATPESGPGSEPATSGSETPGSEPATSGSETPGSPAGSPTSTEEGTSTEPSEGSAPGTSTEPSE GSAPGSEPATSGSETPGTSESATPESGPGTSTEPSEGSAPG |
| 693 | AE1152 | GSPAGSPTSTEEGTSESATPESGPGTSTEPSEGSAPGSPAGSPTSTEEGTSTEPSEGSAPGTS TEPSEGSAPGTSESATPESGPGSEPATSGSETPGSEPATSGSETPGSPAGSPTSTEEGTSESA TPESGPGTSTEPSEGSAPGTSTEPSEGSAPGSPAGSPTSTEEGTSTEPSEGSAPGTSTEPSEGS APGTSESATPESGPGTSTEPSEGSAPGTSESATPESGPGSEPATSGSETPGTSTEPSEGSAPG TSTEPSEGSAPGTSESATPESGPGTSESATPESGPGSPAGSPTSTEEGTSESATPESGPGSEPA TSGSETPGTSESATPESGPGTSTEPSEGSAPGTSTEPSEGSAPGTSTEPSEGSAPGTSTEPSEG SAPGTSTEPSEGSAPGTSTEPSEGSAPGSPAGSPTSTEEGTSTEPSEGSAPGTSESATPESGP GSEPATSGSETPGTSESATPESGPGSEPATSGSETPGTSESATPESGPGTSTEPSEGSAPGTS ESATPESGPGSPAGSPTSTEEGSPAGSPTSTEEGSPAGSPTSTEEGTSESATPESGPGTSTEPS EGSAPGTSESATPESGPGSEPATSGSETPGTSESATPESGPGSEPATSGSETPGTSESATPES GPGTSTEPSEGSAPGSPAGSPTSTEEGTSESATPESGPGSEPATSGSETPGTSESATPESGPG SPAGSPTSTEEGSPAGSPTSTEEGTSTEPSEGSAPGTSESATPESGPGTSESATPESGPGTSES ATPESGPGSEPATSGSETPGSEPATSGSETPGSPAGSPTSTEEGTSTEPSEGSAPGTSTEPSE GSAPGSEPATSGSETPGTSESATPESGPGTSTEPSEGSAPGTSESATPESGPGSEPATSGSET PGTSESATPESGPGSEPATSGSETPGTSESATPESGPGTSTEPSEGSAPGSPAGSPTSTEEGTS ESATPESGPGSEPATSGSETPGTSESATPESGPGSPAGSPTSTEEGSPAGSPTSTEEGTSTEPS EGSAPGTSESATPESGPGTSESATPESGPGTSESATPESGPGSEPATSGSETPGSEPATSGSE TPGSPAGSPTSTEEGTSTEPSEGSAPGTSTEPSEGSAPGSEPATSGSETPGTSESATPESGPG TSTEPSEGSAP |
| 694 | AE144A | STEPSEGSAPGSPAGSPTSTEEGTSTEPSEGSAPGTSESATPESGPGSEPATSGSETPGTSESA TPESGPGSEPATSGSETPGTSESATPESGPGTSTEPSEGSAPGTSESATPESGPGSPAGSPTST EEGSPAGSPTSTEEGS |
| 695 | AE144B | SEPATSGSETPGTSESATPESGPGSEPATSGSETPGTSESATPESGPGTSTEPSEGSAPGSPA GSPTSTEEGTSESATPESGPGSEPATSGSETPGTSESATPESGPGSPAGSPTSTEEGSPAGSPT STEEGTSTEPSEGSAPG |
| 696 | AE180A | TSTEEGTSESATPESGPGSEPATSGSETPGTSESATPESGPGSPAGSPTSTEEGSPAGSPTSTE EGTSTEPSEGSAPGTSESATPESGPGTSESATPESGPGTSESATPESGPGSEPATSGSETPGS EPATSGSETPGSPAGSPTSTEEGTSTEPSEGSAPGTSTEPSEGSAPGSEPATS |
| 697 | AE216A | PESGPGTSTEPSEGSAPGSPAGSPTSTEEGTSESATPESGPGSEPATSGSETPGTSESATPESG PGSPAGSPTSTEEGSPAGSPTSTEEGTSTEPSEGSAPGTSESATPESGPGTSESATPESGPGTS ESATPESGPGSEPATSGSETPGSEPATSGSETPGSPAGSPTSTEEGTSTEPSEGSAPGTSTEPS EGSAPGSEPATSGSETPGTSESAT |
| 698 | AE252A | ESGPGSEPATSGSETPGTSESATPESGPGTSTEPSEGSAPGSPAGSPTSTEEGTSESATPESGP GSEPATSGSETPGTSESATPESGPGSPAGSPTSTEEGSPAGSPTSTEEGTSTEPSEGSAPGTS ESATPESGPGTSESATPESGPGTSESATPESGPGSEPATSGSETPGSEPATSGSETPGSPAGS PTSTEEGTSTEPSEGSAPGTSTEPSEGSAPGSEPATSGSETPGTSESATPESGPGTSTEPSE |
| 699 | AE288A | TPESGPGTSTEPSEGSAPGTSESATPESGPGSEPATSGSETPGTSESATPESGPGSEPATSGSE TPGTSESATPESGPGTSTEPSEGSAPGSPAGSPTSTEEGTSESATPESGPGSEPATSGSETPG TSESATPESGPGSPAGSPTSTEEGSPAGSPTSTEEGTSTEPSEGSAPGTSESATPESGPGTSES ATPESGPGTSESATPESGPGSEPATSGSETPGSEPATSGSETPGSPAGSPTSTEEGTSTEPSE GSAPGTSTEPSEGSAPGSEPATSGSETPGTSESA |

TABLE 3b-continued

Exemplary General-Purpose XTENs That for Engineering into Barcoded XTEN(s)

| SEQ ID NO | XTEN Name | Amino Acid Sequence |
|---|---|---|
| 700 | AE324A | PESGPGSPAGSPTSTEEGSPAGSPTSTEEGSPAGSPTSTEEGTSESATPESGPGTSTEPSEGSA<br>PGTSESATPESGPGSEPATSGSETPGTSESATPESGPGSEPATSGSETPGTSESATPESGPGTS<br>TEPSEGSAPGSPAGSPTSTEEGTSESATPESGPGSEPATSGSETPGTSESATPESGPGSPAGS<br>PTSTEEGSPAGSPTSTEEGTSTEPSEGSAPGTSESATPESGPGTSESATPESGPGTSESATPES<br>GPGSEPATSGSETPGSEPATSGSETPGSPAGSPTSTEEGTSTEPSEGSAPGTSTEPSEGSAPG<br>SEPATS |
| 701 | AE360A | PESGPGTSTEPSEGSAPGTSESATPESGPGSPAGSPTSTEEGSPAGSPTSTEEGSPAGSPTSTE<br>EGTSESATPESGPGTSTEPSEGSAPGTSESATPESGPGSEPATSGSETPGTSESATPESGPGS<br>EPATSGSETPGTSESATPESGPGTSTEPSEGSAPGSPAGSPTSTEEGTSESATPESGPGSEPA<br>TSGSETPGTSESATPESGPGSPAGSPTSTEEGSPAGSPTSTEEGTSTEPSEGSAPGTSESATPE<br>SGPGTSESATPESGPGTSESATPESGPGSEPATSGSETPGSEPATSGSETPGSPAGSPTSTEE<br>GTSTEPSEGSAPGTSTEPSEGSAPGSEPATSGSETPGTSESAT |
| 702 | AE396A | PESGPGSEPATSGSETPGTSESATPESGPGTSTEPSEGSAPGTSESATPESGPGSPAGSPTSTE<br>EGSPAGSPTSTEEGSPAGSPTSTEEGTSESATPESGPGTSTEPSEGSAPGTSESATPESGPGS<br>EPATSGSETPGTSESATPESGPGSEPATSGSETPGTSESATPESGPGTSTEPSEGSAPGSPAG<br>SPTSTEEGTSESATPESGPGSEPATSGSETPGTSESATPESGPGSPAGSPTSTEEGSPAGSPTS<br>TEEGTSTEPSEGSAPGTSESATPESGPGTSESATPESGPGTSESATPESGPGSEPATSGSETP<br>GSEPATSGSETPGSPAGSPTSTEEGTSTEPSEGSAPGTSTEPS |
| 703 | AE432A | EGSAPGSPAGSPTSTEEGTSTEPSEGSAPGTSESATPESGPGSEPATSGSETPGTSESATPES<br>GPGSEPATSGSETPGTSESATPESGPGTSTEPSEGSAPGTSESATPESGPGSPAGSPTSTEEG<br>SPAGSPTSTEEGSPAGSPTSTEEGTSESATPESGPGTSTEPSEGSAPGTSESATPESGPGSEPA<br>TSGSETPGTSESATPESGPGSEPATSGSETPGTSESATPESGPGTSTEPSEGSAPGSPAGSPTS<br>TEEGTSESATPESGPGSEPATSGSETPGTSESATPESGPGSPAGSPTSTEEGSPAGSPTSTEE<br>GTSTEPSEGSAPGTSESATPESGPGTSESATPESGPGTSESATPESGPGSEPATSGSETPGSEP<br>ATSGSETPGSPAGSPTSTEEGTSTEPSEGSAPGTSTEPSEGSAPGSEPATS |
| 704 | AE468A | EGSAPGTSTEPSEGSAPGTSTEPSEGSAPGSPAGSPTSTEEGTSTEPSEGSAPGTSESATPES<br>GPGSEPATSGSETPGTSESATPESGPGSEPATSGSETPGTSESATPESGPGTSTEPSEGSAPG<br>TSESATPESGPGSPAGSPTSTEEGSPAGSPTSTEEGSPAGSPTSTEEGTSESATPESGPGTSTE<br>PSEGSAPGTSESATPESGPGSEPATSGSETPGTSESATPESGPGSEPATSGSETPGTSESATPE<br>SGPGTSTEPSEGSAPGSPAGSPTSTEEGTSESATPESGPGSEPATSGSETPGTSESATPESGP<br>GSPAGSPTSTEEGSPAGSPTSTEEGTSTEPSEGSAPGTSESATPESGPGTSESATPESGPGTS<br>ESATPESGPGSEPATSGSETPGSEPATSGSETPGSPAGSPTSTEEGTSTEPSEGSAPGTSTEPS<br>EGSAPGSEPATSGSETPGTSESAT |
| 705 | AE504A | EGSAPGTSTEPSEGSAPGTSTEPSEGSAPGTSTEPSEGSAPGTSTEPSEGSAPGSPAGSPTST<br>EEGTSTEPSEGSAPGTSESATPESGPGSEPATSGSETPGTSESATPESGPGSEPATSGSETPG<br>TSESATPESGPGTSTEPSEGSAPGTSESATPESGPGSPAGSPTSTEEGSPAGSPTSTEEGSPA<br>GSPTSTEEGTSESATPESGPGTSTEPSEGSAPGTSESATPESGPGSEPATSGSETPGTSESATP<br>ESGPGSEPATSGSETPGTSESATPESGPGTSTEPSEGSAPGSPAGSPTSTEEGTSESATPESGP<br>GSEPATSGSETPGTSESATPESGPGSPAGSPTSTEEGSPAGSPTSTEEGTSTEPSEGSAPGTS<br>ESATPESGPGTSESATPESGPGTSESATPESGPGSEPATSGSETPGSEPATSGSETPGSPAGS<br>PTSTEEGTSTEPSEGSAPGTSTEPSEGSAPGSEPATSGSETPGTSESATPESGPGTSTEPS |
| 706 | AE540A | TPESGPGSPAGSPTSTEEGTSESATPESGPGSEPATSGSETPGTSESATPESGPGTSTEPSEGS<br>APGTSTEPSEGSAPGTSTEPSEGSAPGTSTEPSEGSAPGTSTEPSEGSAPGTSTEPSEGSAPG<br>SPAGSPTSTEEGTSTEPSEGSAPGTSESATPESGPGSEPATSGSETPGTSESATPESGPGSEPA<br>TSGSETPGTSESATPESGPGTSTEPSEGSAPGTSESATPESGPGSPAGSPTSTEEGSPAGSPTS<br>TEEGSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTS<br>ESATPESGPGSEPATSGSETPGTSESATPESGPGSPAGSPTSTEEGSPAGSPTSTEEGTSTEPS<br>EGSAPGTSESATPESGPGTSESATPESGPGTSESATPESGPGSEPATSGSETPGSEPATSGSE<br>TPGSPAGSPTSTEEGTSTEPSEGSAPGTSTEP |
| 707 | AE576A | TPESGPGTSESATPESGPGSPAGSPTSTEEGTSESATPESGPGSEPATSGSETPGTSESATPES<br>GPGTSTEPSEGSAPGTSTEPSEGSAPGTSTEPSEGSAPGTSTEPSEGSAPGTSTEPSEGSAPG<br>TSTEPSEGSAPGSPAGSPTSTEEGTSTEPSEGSAPGTSESATPESGPGSEPATSGSETPGTSES<br>ATPESGPGSEPATSGSETPGTSESATPESGPGTSTEPSEGSAPGTSESATPESGPGSPAGSPT<br>STEEGSPAGSPTSTEEGSPAGSPTSTEEGTSESATPESGPGTSTEPSEGSAPGTSESATPESGP<br>GSEPATSGSETPGTSESATPESGPGSEPATSGSETPGTSESATPESGPGTSTEPSEGSAPGSP<br>AGSPTSTEEGTSESATPESGPGSEPATSGSETPGTSESATPESGPGSPAGSPTSTEEGSPAGS<br>PTSTEEGTSTEPSEGSAPGTSESATPESGPGTSESATPESGPGTSESATPESGPGSEPATSGSE<br>TPGSEPATSGSETPGSPAGSPTSTEEGTSTEPSEGSAPGTSTEPSEGSAPGSEPATSGSETPG<br>TSESA |
| 708 | AE612A | GSETPGTSTEPSEGSAPGTSTEPSEGSAPGTSESATPESGPGTSESATPESGPGSPAGSPTSTE<br>EGTSESATPESGPGSEPATSGSETPGTSESATPESGPGTSTEPSEGSAPGTSTEPSEGSAPGT<br>STEPSEGSAPGTSTEPSEGSAPGTSTEPSEGSAPGTSTEPSEGSAPGSPAGSPTSTEEGTSTEP<br>SEGSAPGTSESATPESGPGSEPATSGSETPGTSESATPESGPGSEPATSGSETPGTSESATPES<br>GPGTSTEPSEGSAPGTSESATPESGPGSPAGSPTSTEEGSPAGSPTSTEEGSPAGSPTSTEEG<br>TSESATPESGPGTSTEPSEGSAPGTSESATPESGPGSEPATSGSETPGTSESATPESGPGSEPA |

TABLE 3b-continued

Exemplary General-Purpose XTENs That for Engineering into Barcoded XTEN(s)

| SEQ ID NO | XTEN Name | Amino Acid Sequence |
|---|---|---|
| | | TSGSETPGTSESATPESGPGTSTEPSEGSAPGSPAGSPTSTEEGTSESATPESGPGSEPATSGS<br>ETPGTSESATPESGPGSPAGSPTSTEEGSPAGSPTSTEEGTSTEPSEGSAPGTSESATPESGP<br>GTSESATPESGPGTSESATPESGPGSEPATSGSETPGSEPATSGSETPGSPAGSPTSTEEGTS<br>TEPSEGSAPGTSTEPSEGSAPGSEPATSGSETPGTSESAT |
| 709 | AE648 A | PESGPGTSTEPSEGSAPGTSESATPESGPGSEPATSGSETPGTSTEPSEGSAPGTSTEPSEGSA<br>PGTSESATPESGPGTSESATPESGPGSPAGSPTSTEEGTSESATPESGPGSEPATSGSETPGTS<br>ESATPESGPGTSTEPSEGSAPGTSTEPSEGSAPGTSTEPSEGSAPGTSTEPSEGSAPGTSTEPS<br>EGSAPGTSTEPSEGSAPGSPAGSPTSTEEGTSTEPSEGSAPGTSESATPESGPGSEPATSGSE<br>TPGTSESATPESGPGSEPATSGSETPGTSESATPESGPGTSTEPSEGSAPGTSESATPESGPGS<br>PAGSPTSTEEGSPAGSPTSTEEGSPAGSPTSTEEGTSESATPESGPGTSTEPSEGSAPGTSES<br>ATPESGPGSEPATSGSETPGTSESATPESGPGSEPATSGSETPGTSESATPESGPGTSTEPSE<br>GSAPGSPAGSPTSTEEGTSESATPESGPGSEPATSGSETPGTSESATPESGPGSPAGSPTSTE<br>EGSPAGSPTSTEEGTSTEPSEGSAPGTSESATPESGPGTSESATPESGPGTSESATPESGPGS<br>EPATSGSETPGSEPATSGSETPGSPAGSPTSTEEGTSTEPSEGSAPGTSTEPSEGSAPGSEPA<br>TSGSETPGTSESAT |
| 710 | AE684 A | EGSAPGSPAGSPTSTEEGTSTEPSEGSAPGTSTEPSEGSAPGTSESATPESGPGTSTEPSEGS<br>APGTSESATPESGPGSEPATSGSETPGTSTEPSEGSAPGTSTEPSEGSAPGTSESATPESGPG<br>TSESATPESGPGSPAGSPTSTEEGTSESATPESGPGSEPATSGSETPGTSESATPESGPGTSTE<br>PSEGSAPGTSTEPSEGSAPGTSTEPSEGSAPGTSTEPSEGSAPGTSTEPSEGSAPGTSTEPSEG<br>SAPGSPAGSPTSTEEGTSTEPSEGSAPGTSESATPESGPGSEPATSGSETPGTSESATPESGP<br>GSEPATSGSETPGTSESATPESGPGTSTEPSEGSAPGTSESATPESGPGSPAGSPTSTEEGSP<br>AGSPTSTEEGSPAGSPTSTEEGTSESATPESGPGTSTEPSEGSAPGTSESATPESGPGSEPAT<br>SGSETPGTSESATPESGPGSEPATSGSETPGTSESATPESGPGTSTEPSEGSAPGSPAGSPTST<br>EEGTSESATPESGPGSEPATSGSETPGTSESATPESGPGSPAGSPTSTEEGSPAGSPTSTEEG<br>TSTEPSEGSAPGTSESATPESGPGTSESATPESGPGTSESATPESGPGSEPATSGSETPGSEPA<br>TSGSETPGSPAGSPTSTEEGTSTEPSEGSAPGTSTEPSEGSAPGSEPATS |
| 711 | AE720 A | TSGSETPGSEPATSGSETPGSPAGSPTSTEEGTSESATPESGPGTSTEPSEGSAPGTSTEPSEG<br>SAPGSPAGSPTSTEEGTSTEPSEGSAPGTSTEPSEGSAPGTSESATPESGPGTSTEPSEGSAP<br>GTSESATPESGPGSEPATSGSETPGTSTEPSEGSAPGTSTEPSEGSAPGTSESATPESGPGTS<br>ESATPESGPGSPAGSPTSTEEGTSESATPESGPGSEPATSGSETPGTSESATPESGPGTSTEPS<br>EGSAPGTSTEPSEGSAPGTSTEPSEGSAPGTSTEPSEGSAPGTSTEPSEGSAPGTSTEPSEGS<br>APGSPAGSPTSTEEGTSTEPSEGSAPGTSESATPESGPGSEPATSGSETPGTSESATPESGPG<br>SEPATSGSETPGTSESATPESGPGTSTEPSEGSAPGTSESATPESGPGSPAGSPTSTEEGSPA<br>GSPTSTEEGSPAGSPTSTEEGTSESATPESGPGTSTEPSEGSAPGTSESATPESGPGSEPATS<br>GSETPGTSESATPESGPGSEPATSGSETPGTSESATPESGPGTSTEPSEGSAPGSPAGSPTSTE<br>EGTSESATPESGPGSEPATSGSETPGTSESATPESGPGSPAGSPTSTEEGSPAGSPTSTEEGT<br>STEPSEGSAPGTSESATPESGPGTSESATPESGPGTSESATPESGPGSEPATSGSETPGSEPAT<br>SGSETPGSPAGSPTSTEEGTSTE |
| 712 | AE756 A | TSGSETPGSEPATSGSETPGSPAGSPTSTEEGTSESATPESGPGTSTEPSEGSAPGTSTEPSEG<br>SAPGSPAGSPTSTEEGTSTEPSEGSAPGTSTEPSEGSAPGTSESATPESGPGTSTEPSEGSAP<br>GTSESATPESGPGSEPATSGSETPGTSTEPSEGSAPGTSTEPSEGSAPGTSESATPESGPGTS<br>ESATPESGPGSPAGSPTSTEEGTSESATPESGPGSEPATSGSETPGTSESATPESGPGTSTEPS<br>EGSAPGTSTEPSEGSAPGTSTEPSEGSAPGTSTEPSEGSAPGTSTEPSEGSAPGTSTEPSEGS<br>APGSPAGSPTSTEEGTSTEPSEGSAPGTSESATPESGPGSEPATSGSETPGTSESATPESGPG<br>SEPATSGSETPGTSESATPESGPGTSTEPSEGSAPGTSESATPESGPGSPAGSPTSTEEGSPA<br>GSPTSTEEGSPAGSPTSTEEGTSESATPESGPGTSTEPSEGSAPGTSESATPESGPGSEPATS<br>GSETPGTSESATPESGPGSEPATSGSETPGTSESATPESGPGTSTEPSEGSAPGSPAGSPTSTE<br>EGTSESATPESGPGSEPATSGSETPGTSESATPESGPGSPAGSPTSTEEGSPAGSPTSTEEGT<br>STEPSEGSAPGTSESATPESGPGTSESATPESGPGTSESATPESGPGSEPATSGSETPGSEPAT<br>SGSETPGSPAGSPTSTEEGTSTEPSEGSAPGTSTEPSEGSAPGSEPATSGSETPGTSES |
| 713 | AE792 A | EGSAPGTSESATPESGPGSEPATSGSETPGSEPATSGSETPGSPAGSPTSTEEGTSESATPES<br>GPGTSTEPSEGSAPGTSTEPSEGSAPGSPAGSPTSTEEGTSTEPSEGSAPGTSTEPSEGSAPG<br>TSESATPESGPGTSTEPSEGSAPGTSESATPESGPGSEPATSGSETPGTSTEPSEGSAPGTSTE<br>PSEGSAPGTSESATPESGPGTSESATPESGPGSPAGSPTSTEEGTSESATPESGPGSEPATSG<br>SETPGTSESATPESGPGTSTEPSEGSAPGTSTEPSEGSAPGTSTEPSEGSAPGTSTEPSEGSAP<br>GTSTEPSEGSAPGTSTEPSEGSAPGSPAGSPTSTEEGTSTEPSEGSAPGTSESATPESGPGSEP<br>ATSGSETPGTSESATPESGPGSEPATSGSETPGTSESATPESGPGTSTEPSEGSAPGTSESAT<br>PESGPGSPAGSPTSTEEGSPAGSPTSTEEGSPAGSPTSTEEGTSESATPESGPGTSTEPSEGSA<br>PGTSESATPESGPGSEPATSGSETPGTSESATPESGPGSEPATSGSETPGTSESATPESGPGTS<br>TEPSEGSAPGSPAGSPTSTEEGTSESATPESGPGSEPATSGSETPGTSESATPESGPGSPAGS<br>PTSTEEGSPAGSPTSTEEGTSTEPSEGSAPGTSESATPESGPGTSESATPESGPGTSESATPES<br>GPGSEPATSGSETPGSEPATSGSETPGSPAGSPTSTEEGTSTEPSEGSAPGTSTEPSEGSAPG<br>SEPATSGSETPGTSESATPESGPGTSTEPS |
| 714 | AE828 A | PESGPGTSTEPSEGSAPGSPAGSPTSTEEGTSTEPSEGSAPGTSTEPSEGSAPGTSESATPESG<br>PGSEPATSGSETPGSEPATSGSETPGSPAGSPTSTEEGTSESATPESGPGTSTEPSEGSAPGTS<br>TEPSEGSAPGSPAGSPTSTEEGTSTEPSEGSAPGTSTEPSEGSAPGTSESATPESGPGTSTEPS<br>EGSAPGTSESATPESGPGSEPATSGSETPGTSTEPSEGSAPGTSTEPSEGSAPGTSESATPES<br>GPGTSESATPESGPGSPAGSPTSTEEGTSESATPESGPGSEPATSGSETPGTSESATPESGPG<br>TSTEPSEGSAPGTSTEPSEGSAPGTSTEPSEGSAPGTSTEPSEGSAPGTSTEPSEGSAPGTSTE |

TABLE 3b-continued

Exemplary General-Purpose XTENs That for Engineering into Barcoded XTEN(s)

| SEQ ID NO | XTEN Name | Amino Acid Sequence |
|---|---|---|
| | | PSEGSAPGSPAGSPTSTEEGTSTEPSEGSAPGTSESATPESGPGSEPATSGSETPGTSESATPE<br>SGPGSEPATSGSETPGTSESATPESGPGTSTEPSEGSAPGTSESATPESGPGSPAGSPTSTEE<br>GSPAGSPTSTEEGSPAGSPTSTEEGTSESATPESGPGTSTEPSEGSAPGTSESATPESGPGSEP<br>ATSGSETPGTSESATPESGPGSEPATSGSETPGTSESATPESGPGTSTEPSEGSAPGSPAGSP<br>TSTEEGTSESATPESGPGSEPATSGSETPGTSESATPESGPGSPAGSPTSTEEGSPAGSPTSTE<br>EGTSTEPSEGSAPGTSESATPESGPGTSESATPESGPGTSESATPESGPGSEPATSGSETPGS<br>EPATSGSETPGSPAGSPTSTEEGTSTEPSEGSAPGTSTEPSEGSAPGSEPATSGSETPGTSES<br>AT |
| 715 | AE869 | GSPGSPAGSPTSTEEGTSESATPESGPGTSTEPSEGSAPGSPAGSPTSTEEGTSTEPSEGSAP<br>GTSTEPSEGSAPGTSESATPESGPGSEPATSGSETPGSEPATSGSETPGSPAGSPTSTEEGTS<br>ESATPESGPGTSTEPSEGSAPGTSTEPSEGSAPGSPAGSPTSTEEGTSTEPSEGSAPGTSTEPS<br>EGSAPGTSESATPESGPGTSTEPSEGSAPGTSESATPESGPGSEPATSGSETPGTSTEPSEGS<br>APGTSTEPSEGSAPGTSESATPESGPGTSESATPESGPGSPAGSPTSTEEGTSESATPESGPG<br>SEPATSGSETPGTSESATPESGPGTSTEPSEGSAPGTSTEPSEGSAPGTSTEPSEGSAPGTSTE<br>PSEGSAPGTSTEPSEGSAPGTSTEPSEGSAPGSPAGSPTSTEEGTSTEPSEGSAPGTSESATPE<br>SGPGSEPATSGSETPGTSESATPESGPGSEPATSGSETPGTSESATPESGPGTSTEPSEGSAP<br>GTSESATPESGPGSPAGSPTSTEEGSPAGSPTSTEEGSPAGSPTSTEEGTSESATPESGPGTS<br>TEPSEGSAPGTSESATPESGPGSEPATSGSETPGTSESATPESGPGSEPATSGSETPGTSESA<br>TPESGPGTSTEPSEGSAPGSPAGSPTSTEEGTSESATPESGPGSEPATSGSETPGTSESATPES<br>GPGSPAGSPTSTEEGSPAGSPTSTEEGTSTEPSEGSAPGTSESATPESGPGTSESATPESGPG<br>TSESATPESGPGSEPATSGSETPGSEPATSGSETPGSPAGSPTSTEEGTSTEPSEGSAPGTSTE<br>PSEGSAPGSEPATSGSETPGTSESATPESGPGTSTEPSEGSAPGR |
| 716 | AE144_R1 | SAGSPGSPAGSPTSTEEGTSESATPESGPGTSTEPSEGSAPGSPAGSPTSTEEGTSTEPSEGS<br>APGTSTEPSEGSAPGTSESATPESGPGSEPATSGSETPGSEPATSGSETPGSPAGSPTSTEEG<br>TSESATPESGPGTESASR |
| 717 | AE288_R1 | SAGSPTGPGSEPATSGSETPGTSESATPESGPGSEPATSGSETPGTSESATPESGPGTSTEPSE<br>GSAPGSPAGSPTSTEEGTSESATPESGPGSEPATSGSETPGTSESATPESGPGSPAGSPTSTE<br>EGSPAGSPTSTEEGTSTEPSEGSAPGTSESATPESGPGTSESATPESGPGTSESATPESGPGS<br>EPATSGSETPGSEPATSGSETPGSPAGSPTSTEEGTSTEPSEGSAPGTSTEPSEGSAPGSEPA<br>TSGSETPGTSESATPESGPGTSTEPSEGSAPSASR |
| 718 | AE432_R1 | SAGSPGSPAGSPTSTEEGTSESATPESGPGTSTEPSEGSAPGSPAGSPTSTEEGTSTEPSEGS<br>APGTSTEPSEGSAPGTSESATPESGPGSEPATSGSETPGSEPATSGSETPGSPAGSPTSTEEG<br>TSESATPESGPGTSTEPSEGSAPGTSTEPSEGSAPGSPAGSPTSTEEGTSTEPSEGSAPGTSTE<br>PSEGSAPGTSESATPESGPGTSTEPSEGSAPGTSESATPESGPGSEPATSGSETPGTSTEPSEG<br>SAPGTSTEPSEGSAPGTSESATPESGPGTSESATPESGPGSPAGSPTSTEEGTSESATPESGP<br>GSEPATSGSETPGTSESATPESGPGTSTEPSEGSAPGTSTEPSEGSAPGTSTEPSEGSAPGTS<br>TEPSEGSAPGTSTEPSEGSAPGTSTEPSEGSAPGSPAGSPTSTEEGTESASR |
| 719 | AE576_R1 | SAGSPTEEGTSESATPESGPGSEPATSGSETPGTSESATPESGPGTSTEPSEGSAPGTSTEPSE<br>GSAPGTSTEPSEGSAPGTSTEPSEGSAPGTSTEPSEGSAPGTSTEPSEGSAPGSPAGSPTSTE<br>EGTSTEPSEGSAPGTSESATPESGPGSEPATSGSETPGTSESATPESGPGSEPATSGSETPGT<br>SESATPESGPGTSTEPSEGSAPGTSESATPESGPGSPAGSPTSTEEGSPAGSPTSTEEGSPAG<br>SPTSTEEGTSESATPESGPGTSTEPSEGSAPGTSESATPESGPGSEPATSGSETPGTSESATPE<br>SGPGSEPATSGSETPGTSESATPESGPGTSTEPSEGSAPGSPAGSPTSTEEGTSESATPESGP<br>GSEPATSGSETPGTSESATPESGPGSPAGSPTSTEEGSPAGSPTSTEEGTSTEPSEGSAPGTS<br>ESATPESGPGTSESATPESGPGTSESATPESGPGSEPATSGSETPGSEPATSGSETPGSPAGS<br>PTSTEEGTSTEPSEGSAPGTSTEPSEGSAPGSEPATSGSETPGTSESATPESGPGTSTEPSEGS<br>APSASR |
| 720 | AE864_R1 | SAGSPGSPAGSPTSTEEGTSESATPESGPGTSTEPSEGSAPGSPAGSPTSTEEGTSTEPSEGS<br>APGTSTEPSEGSAPGTSESATPESGPGSEPATSGSETPGSEPATSGSETPGSPAGSPTSTEEG<br>TSESATPESGPGTSTEPSEGSAPGTSTEPSEGSAPGSPAGSPTSTEEGTSTEPSEGSAPGTSTE<br>PSEGSAPGTSESATPESGPGTSTEPSEGSAPGTSESATPESGPGSEPATSGSETPGTSTEPSEG<br>SAPGTSTEPSEGSAPGTSESATPESGPGTSESATPESGPGSPAGSPTSTEEGTSESATPESGP<br>GSEPATSGSETPGTSESATPESGPGTSTEPSEGSAPGTSTEPSEGSAPGTSTEPSEGSAPGTS<br>TEPSEGSAPGTSTEPSEGSAPGTSTEPSEGSAPGSPAGSPTSTEEGTSTEPSEGSAPGTSESA<br>TPESGPGSEPATSGSETPGTSESATPESGPGSEPATSGSETPGTSESATPESGPGTSTEPSEGS<br>APGTSESATPESGPGSPAGSPTSTEEGSPAGSPTSTEEGSPAGSPTSTEEGTSESATPESGPG<br>TSTEPSEGSAPGTSESATPESGPGSEPATSGSETPGTSESATPESGPGSEPATSGSETPGTSES<br>ATPESGPGTSTEPSEGSAPGSPAGSPTSTEEGTSESATPESGPGSEPATSGSETPGTSESATP<br>ESGPGSPAGSPTSTEEGSPAGSPTSTEEGTSTEPSEGSAPGTSESATPESGPGTSESATPESGP<br>GTSESATPESGPGSEPATSGSETPGSEPATSGSETPGSPAGSPTSTEEGTSTEPSEGSAPGTS<br>TEPSEGSAPGSEPATSGSETPGTSESATPESGPGTESASR |
| 721 | AE712 | PGSPAGSPTSTEEGTSESATPESGPGTSTEPSEGSAPGSPAGSPTSTEEGTSTEPSEGSAPGTS<br>TEPSEGSAPGTSESATPESGPGSEPATSGSETPGSEPATSGSETPGSPAGSPTSTEEGTSESA<br>TPESGPGTSTEPSEGSAPGTSTEPSEGSAPGSPAGSPTSTEEGTSTEPSEGSAPGTSTEPSEGS<br>APGTSESATPESGPGTSTEPSEGSAPGTSESATPESGPGSEPATSGSETPGTSTEPSEGSAPG<br>TSTEPSEGSAPGTSESATPESGPGTSESATPESGPGSPAGSPTSTEEGTSESATPESGPGSEPA<br>TSGSETPGTSESATPESGPGTSTEPSEGSAPGTSTEPSEGSAPGTSTEPSEGSAPGTSTEPSEG<br>SAPGTSTEPSEGSAPGTSTEPSEGSAPGSPAGSPTSTEEGTSTEPSEGSAPGTSESATPESGP |

TABLE 3b-continued

Exemplary General-Purpose XTENs That for Engineering into Barcoded XTEN(s)

| SEQ ID NO | XTEN Name | Amino Acid Sequence |
|---|---|---|
| | | GSEPATSGSETPGTSESATPESGPGSEPATSGSETPGTSESATPESGPGTSTEPSEGSAPGTS<br>ESATPESGPGSPAGSPTSTEEGSPAGSPTSTEEGSPAGSPTSTEEGTSESATPESGPGTSTEPS<br>EGSAPGTSESATPESGPGSEPATSGSETPGTSESATPESGPGSEPATSGSETPGTSESATPES<br>GPGTSTEPSEGSAPGSPAGSPTSTEEGTSESATPESGPGSEPATSGSETPGTSESATPESGPG<br>SPAGSPTSTEAHHH |
| 722 | AE864_R2 | GSPGAGSPAGSPTSTEEGTSESATPESGPGTSTEPSEGSAPGSPAGSPTSTEEGTSTEPSEGS<br>APGTSTEPSEGSAPGTSESATPESGPGSEPATSGSETPGSEPATSGSETPGSPAGSPTSTEEG<br>TSESATPESGPGTSTEPSEGSAPGTSTEPSEGSAPGSPAGSPTSTEEGTSTEPSEGSAPGTSTE<br>PSEGSAPGTSESATPESGPGTSTEPSEGSAPGTSESATPESGPGSEPATSGSETPGTSTEPSEG<br>SAPGTSTEPSEGSAPGTSESATPESGPGTSESATPESGPGSPAGSPTSTEEGTSESATPESGP<br>GSEPATSGSETPGTSESATPESGPGTSTEPSEGSAPGTSTEPSEGSAPGTSTEPSEGSAPGTS<br>TEPSEGSAPGTSTEPSEGSAPGTSTEPSEGSAPGSPAGSPTSTEEGTSTEPSEGSAPGTSESA<br>TPESGPGSEPATSGSETPGTSESATPESGPGSEPATSGSETPGTSESATPESGPGTSTEPSEGS<br>APGTSESATPESGPGSPAGSPTSTEEGSPAGSPTSTEEGSPAGSPTSTEEGTSESATPESGPG<br>TSTEPSEGSAPGTSESATPESGPGSEPATSGSETPGTSESATPESGPGSEPATSGSETPGTSES<br>ATPESGPGTSTEPSEGSAPGSPAGSPTSTEEGTSESATPESGPGSEPATSGSETPGTSESATP<br>ESGPGSPAGSPTSTEEGSPAGSPTSTEEGTSTEPSEGSAPGTSESATPESGPGTSESATPESGP<br>GTSESATPESGPGSEPATSGSETPGSEPATSGSETPGSPAGSPTSTEEGTSTEPSEGSAPGTS<br>TEPSEGSAPGSEPATSGSETPGTSESATPESGPGTESASR |
| 723 | AE288_3 | SPAGSPTSTEEGTSESATPESGPGTSTEPSEGSAPGTSESATPESGPGSEPATSGSETPGTSES<br>ATPESGPGSEPATSGSETPGTSESATPESGPGTSTEPSEGSAPGSPAGSPTSTEEGTSESATP<br>ESGPGSEPATSGSETPGTSESATPESGPGSPAGSPTSTEEGSPAGSPTSTEEGTSTEPSEGSAP<br>GTSESATPESGPGTSESATPESGPGTSESATPESGPGSEPATSGSETPGSEPATSGSETPGSP<br>AGSPTSTEEGTSTEPSEGSAPGTSTEPSEGSAPG |
| 724 | AE284 | GTSESATPESGPGSEPATSGSETPGTSESATPESGPGSEPATSGSETPGTSESATPESGPGTS<br>TEPSEGSAPGSPAGSPTSTEEGTSESATPESGPGSEPATSGSETPGTSESATPESGPGSPAGS<br>PTSTEEGSPAGSPTSTEEGTSTEPSEGSAPGTSESATPESGPGTSESATPESGPGTSESATPES<br>GPGSEPATSGSETPGSEPATSGSETPGSPAGSPTSTEEGTSTEPSEGSAPGTSTEPSEGSAPG<br>SEPATSGSETPGTSESATPESGPGTSTEPSE |
| 725 | AE292 | SPAGSPTSTEEGTSESATPESGPGTSTEPSEGSAPGTSESATPESGPGSEPATSGSETPGTSES<br>ATPESGPGSEPATSGSETPGTSESATPESGPGTSTEPSEGSAPGSPAGSPTSTEEGTSESATP<br>ESGPGSEPATSGSETPGTSESATPESGPGSPAGSPTSTEEGSPAGSPTSTEEGTSTEPSEGSAP<br>GTSESATPESGPGTSESATPESGPGTSESATPESGPGSEPATSGSETPGSEPATSGSETPGSP<br>AGSPTSTEEGTSTEPSEGSAPGTSTEPSEGSAPGGSAP |
| 726 | AE864_2 | AGSPTSTEEGTSESATPESGPGTSTEPSEGSAPGSPAGSPTSTEEGTSTEPSEGSAPGTSTEPS<br>EGSAPGTSESATPESGPGSEPATSGSETPGSEPATSGSETPGSPAGSPTSTEEGTSESATPES<br>GPGTSTEPSEGSAPGTSTEPSEGSAPGSPAGSPTSTEEGTSTEPSEGSAPGTSTEPSEGSAPG<br>TSESATPESGPGTSTEPSEGSAPGTSESATPESGPGSEPATSGSETPGTSTEPSEGSAPGTSTE<br>PSEGSAPGTSESATPESGPGTSESATPESGPGSPAGSPTSTEEGTSESATPESGPGSEPATSG<br>SETPGTSESATPESGPGTSTEPSEGSAPGTSTEPSEGSAPGTSTEPSEGSAPGTSTEPSEGSAP<br>GTSTEPSEGSAPGTSTEPSEGSAPGSPAGSPTSTEEGTSTEPSEGSAPGTSESATPESGPGSEP<br>ATSGSETPGTSESATPESGPGSEPATSGSETPGTSESATPESGPGTSTEPSEGSAPGTSESAT<br>PESGPGSPAGSPTSTEEGSPAGSPTSTEEGSPAGSPTSTEEGTSESATPESGPGTSTEPSEGSA<br>PGTSESATPESGPGSEPATSGSETPGTSESATPESGPGSEPATSGSETPGTSESATPESGPGTS<br>TEPSEGSAPGSPAGSPTSTEEGTSESATPESGPGSEPATSGSETPGTSESATPESGPGSPAGS<br>PTSTEEGSPAGSPTSTEEGTSTEPSEGSAPGTSESATPESGPGTSESATPESGPGTSESATPES<br>GPGSEPATSGSETPGSEPATSGSETPGSPAGSPTSTEEGTSTEPSEGSAPGTSTEPSEGSAPG<br>SEPATSGSETPGTSESATPESGPGTSTEPSEGAAEPEA |
| 727 | AE867 | GSPAGSPTSTEEGTSESATPESGPGTSTEPSEGSAPGSPAGSPTSTEEGTSTEPSEGSAPGTS<br>TEPSEGSAPGTSESATPESGPGSEPATSGSETPGSEPATSGSETPGSPAGSPTSTEEGTSESA<br>TPESGPGTSTEPSEGSAPGTSTEPSEGSAPGSPAGSPTSTEEGTSTEPSEGSAPGTSTEPSEGS<br>APGTSESATPESGPGTSTEPSEGSAPGTSESATPESGPGSEPATSGSETPGTSTEPSEGSAPG<br>TSTEPSEGSAPGTSESATPESGPGTSESATPESGPGSPAGSPTSTEEGTSESATPESGPGSEPA<br>TSGSETPGTSESATPESGPGTSTEPSEGSAPGTSTEPSEGSAPGTSTEPSEGSAPGTSTEPSEG<br>SAPGTSTEPSEGSAPGTSTEPSEGSAPGSPAGSPTSTEEGTSTEPSEGSAPGTSESATPESGP<br>GSEPATSGSETPGTSESATPESGPGSEPATSGSETPGTSESATPESGPGTSTEPSEGSAPGTS<br>ESATPESGPGSPAGSPTSTEEGSPAGSPTSTEEGSPAGSPTSTEEGTSESATPESGPGTSTEPS<br>EGSAPGTSESATPESGPGSEPATSGSETPGTSESATPESGPGSEPATSGSETPGTSESATPES<br>GPGTSTEPSEGSAPGSPAGSPTSTEEGTSESATPESGPGSEPATSGSETPGTSESATPESGPG<br>SPAGSPTSTEEGSPAGSPTSTEEGTSTEPSEGSAPGTSESATPESGPGTSESATPESGPGTSES<br>ATPESGPGSEPATSGSETPGSEPATSGSETPGSPAGSPTSTEEGTSTEPSEGSAPGTSTEPSE<br>GSAPGSEPATSGSETPGTSESATPESGPGTSTEPSEGAAEPEA |
| 728 | AE867_2 | SPGSPAGSPTSTEEGTSESATPESGPGTSTEPSEGSAPGSPAGSPTSTEEGTSTEPSEGSAPGT<br>STEPSEGSAPGTSESATPESGPGSEPATSGSETPGSEPATSGSETPGSPAGSPTSTEEGTSESA<br>TPESGPGTSTEPSEGSAPGTSTEPSEGSAPGSPAGSPTSTEEGTSTEPSEGSAPGTSTEPSEGS<br>APGTSESATPESGPGTSTEPSEGSAPGTSESATPESGPGSEPATSGSETPGTSTEPSEGSAPG<br>TSTEPSEGSAPGTSESATPESGPGTSESATPESGPGSPAGSPTSTEEGTSESATPESGPGSEPA<br>TSGSETPGTSESATPESGPGTSTEPSEGSAPGTSTEPSEGSAPGTSTEPSEGSAPGTSTEPSEG |

TABLE 3b-continued

| Exemplary General-Purpose XTENs That for Engineering into Barcoded XTEN(s) | | |
|---|---|---|
| SEQ ID NO | XTEN Name | Amino Acid Sequence |
| | | SAPGTSTEPSEGSAPGTSTEPSEGSAPGSPAGSPTSTEEGTSTEPSEGSAPGTSESATPESGP<br>GSEPATSGSETPGTSESATPESGPGSEPATSGSETPGTSESATPESGPGTSTEPSEGSAPGTS<br>ESATPESGPGSPAGSPTSTEEGSPAGSPTSTEEGSPAGSPTSTEEGTSESATPESGPGTSTEPS<br>EGSAPGTSESATPESGPGSEPATSGSETPGTSESATPESGPGSEPATSGSETPGTSESATPES<br>GPGTSTEPSEGSAPGSPAGSPTSTEEGTSESATPESGPGSEPATSGSETPGTSESATPESGPG<br>SPAGSPTSTEEGSPAGSPTSTEEGTSTEPSEGSAPGTSESATPESGPGTSESATPESGPGTSES<br>ATPESGPGSEPATSGSETPGSEPATSGSETPGSPAGSPTSTEEGTSTEPSEGSAPGTSTEPSE<br>GSAPGSEPATSGSETPGTSESATPESGPGTSTEPSEGSAPG |
| 729 | AE868 | PGSPAGSPTSTEEGTSESATPESGPGTSTEPSEGSAPGSPAGSPTSTEEGTSTEPSEGSAPGTS<br>TEPSEGSAPGTSESATPESGPGSEPATSGSETPGSEPATSGSETPGSPAGSPTSTEEGTSESA<br>TPESGPGTSTEPSEGSAPGTSTEPSEGSAPGSPAGSPTSTEEGTSTEPSEGSAPGTSTEPSEGS<br>APGTSESATPESGPGTSTEPSEGSAPGTSESATPESGPGSEPATSGSETPGTSTEPSEGSAPG<br>TSTEPSEGSAPGTSESATPESGPGTSESATPESGPGSPAGSPTSTEEGTSESATPESGPGSEPA<br>TSGSETPGTSESATPESGPGTSTEPSEGSAPGTSTEPSEGSAPGTSTEPSEGSAPGTSTEPSEG<br>SAPGTSTEPSEGSAPGTSTEPSEGSAPGSPAGSPTSTEEGTSTEPSEGSAPGTSESATPESGP<br>GSEPATSGSETPGTSESATPESGPGSEPATSGSETPGTSESATPESGPGTSTEPSEGSAPGTS<br>ESATPESGPGSPAGSPTSTEEGSPAGSPTSTEEGSPAGSPTSTEEGTSESATPESGPGTSTEPS<br>EGSAPGTSESATPESGPGSEPATSGSETPGTSESATPESGPGSEPATSGSETPGTSESATPES<br>GPGTSTEPSEGSAPGSPAGSPTSTEEGTSESATPESGPGSEPATSGSETPGTSESATPESGPG<br>SPAGSPTSTEEGSPAGSPTSTEEGTSTEPSEGSAPGTSESATPESGPGTSESATPESGPGTSES<br>ATPESGPGSEPATSGSETPGSEPATSGSETPGSPAGSPTSTEEGTSTEPSEGSAPGTSTEPSE<br>GSAPGSEPATSGSETPGTSESATPESGPGTSTEPSEGAAEPEA |
| 730 | AE144_7A | GSPAGSPTSTEEGTSESATPESGPGTSTEPSEGSAPGSPAGSPTSTEEGTSTEPSEGSAPGTS<br>TEPSEGSAPGTSESATPESGPGSEPATSGSETPGSEPATSGSETPGSPAGSPTSTEEGTSESA<br>TPESGPGTSTEPSEGSAP |
| 731 | AE292 | SPAGSPTSTEEGTSESATPESGPGTSTEPSEGSAPGTSESATPESGPGSEPATSGSETPGTSES<br>ATPESGPGSEPATSGSETPGTSESATPESGPGTSTEPSEGSAPGSPAGSPTSTEEGTSESATP<br>ESGPGSEPATSGSETPGTSESATPESGPGSPAGSPTSTEEGSPAGSPTSTEEGTSTEPSEGSAP<br>GTSESATPESGPGTSESATPESGPGTSESATPESGPGSEPATSGSETPGSEPATSGSETPGSP<br>AGSPTSTEEGTSTEPSEGSAPGTSTEPSEGSAPGGSAP |
| 732 | AE293 | PGSPAGSPTSTEEGTSESATPESGPGTSTEPSEGSAPGSPAGSPTSTEEGTSTEPSEGSAPGTS<br>TEPSEGSAPGTSESATPESGPGSEPATSGSETPGSEPATSGSETPGSPAGSPTSTEEGTSESA<br>TPESGPGTSTEPSEGSAPGTSTEPSEGSAPGSPAGSPTSTEEGTSTEPSEGSAPGTSTEPSEGS<br>APGTSESATPESGPGTSTEPSEGSAPGTSESATPESGPGSEPATSGSETPGTSTEPSEGSAPG<br>TSTEPSEGSAPGTSESATPESGPGTSESATPESGPGSPAGSPTSTEEGTSESATPESGPGSEPA<br>TSGSETPGTSESATPESGPGTSTEPSEGSAPGTSTEPSEGSAPGTSTEPSEGSAPGTSTEPSEG<br>SAPGTSTEPSEGSAPGTSTEPSEGSAPGSPAGSPTSTEEGTSTEPSEGSAPGTSESATPESGP<br>GSEPATSGSETPGTSESATPESGPGSEPATSGSETPGTSESATPESGPGTSTEPSEGSAPGTS<br>ESATPESGPGSPAGSPTSTEEGSPAGSPTSTEEGSPAGSPTSTEEGTSESATPESGPGTSTEPS<br>EGSAPGAAEPEA |
| 733 | AE300 | PGSPAGSPTSTEEGTSESATPESGPGTSTEPSEGSAPGSPAGSPTSTEEGTSTEPSEGSAPGTS<br>TEPSEGSAPGTSESATPESGPGSEPATSGSETPGSEPATSGSETPGSPAGSPTSTEEGTSESA<br>TPESGPGTSTEPSEGSAPGTSTEPSEGSAPGSPAGSPTSTEEGTSTEPSEGSAPGTSTEPSEGS<br>APGTSESATPESGPGTSTEPSEGSAPGTSESATPESGPGSEPATSGSETPGTSTEPSEGSAPG<br>TSTEPSEGSAPGTSESATPESGPGTSESATPESGPGSPAGAAEPEA |
| 734 | AE584 | PGSPAGSPTSTEEGTSESATPESGPGTSTEPSEGSAPGSPAGSPTSTEEGTSTEPSEGSAPGTS<br>TEPSEGSAPGTSESATPESGPGSEPATSGSETPGSEPATSGSETPGSPAGSPTSTEEGTSESA<br>TPESGPGTSTEPSEGSAPGTSTEPSEGSAPGSPAGSPTSTEEGTSTEPSEGSAPGTSTEPSEGS<br>APGTSESATPESGPGTSTEPSEGSAPGTSESATPESGPGSEPATSGSETPGTSTEPSEGSAPG<br>TSTEPSEGSAPGTSESATPESGPGTSESATPESGPGSPAGSPTSTEEGTSESATPESGPGSEPA<br>TSGSETPGTSESATPESGPGTSTEPSEGSAPGTSTEPSEGSAPGTSTEPSEGSAPGTSTEPSEG<br>SAPGTSTEPSEGSAPGTSTEPSEGSAPGSPAGSPTSTEEGTSTEPSEGSAPGTSESATPESGP<br>GSEPATSGSETPGTSESATPESGPGSEPATSGSETPGTSESATPESGPGTSTEPSEGSAPGTS<br>ESATPESGPGSPAGSPTSTEEGSPAGSPTSTEEGSPAGSPTSTEEGTSESATPESGPGTSTEPS<br>EGSAPGAAEPEA |

In some embodiments, for constructing the sequence of a barcoded XTEN polypeptide, amino acid mutations are performed on XTEN polypeptides of intermediate lengths to those of Table 3b, as well as XTEN polypeptides of longer lengths than those of Table 3b, such as those in which one or more 12-mer motifs of Table 1 are added to the N- or C-terminus of a general-purpose XTEN of Table 3b.

Additional examples of general-purpose XTEN polypeptide amino acid sequences that can be used according to the present disclosure are disclosed in U.S. Patent Publication Nos. 2010/0239554 A1, 2010/0323956 A1, 2011/0046060 A1, 2011/0046061 A1, 2011/0077199 A1, or 2011/0172146 A1, or International Patent Publication Nos. WO 2010091122 A1, WO 2010144502 A2, WO 2010144508 A1, WO 2011028228 A1, WO 2011028229 A1, WO 2011028344 A2, WO 2014/011819 A2, or WO 2015/023891, the disclosures of which are each expressly incorporated by reference herein.

In some embodiments, a barcoded XTEN polypeptide fused within a polypeptide chain adjacent to the N-terminus of the polypeptide chain ("N-terminal XTEN") can be attached to a His tag of comprising a plurality of poly(His) residues, including six to eight His residues at the N-terminus to facilitate the purification of the fusion polypeptide. In some embodiments, a barcoded XTEN polypeptide fused within a polypeptide chain at the C-terminus of the polypeptide chain ("C-terminal XTEN polypeptide") can be comprise or be attached to the sequence EPEA at the C-terminus to facilitate the purification of the fusion polypeptide. In some embodiment, the fusion polypeptide comprises both an N-terminal barcoded XTEN polypeptide and a C-terminal barcoded XTEN polypeptide, wherein the N-terminal barcoded XTEN is attached to a His tag of comprising a plurality of poly(His) residues, including six to eight His residues at the N-terminus; and wherein the C-terminal barcoded XTEN polypeptide is attached to the sequence EPEA at the C-terminus, thereby facilitating purification of the fusion polypeptide, for example, to at least 90%, 91%, 92%, 93%, 94%, 95%, 96%, 97%, 98%, or at least 99% purity by chromatography methods known in the art, including but not limited to IMAC chromatography, C-tagXL affinity matrix, and other such methods, including but not limited to those described in the EXAMPLES section below.

Protease Digestion

A barcode fragment, as described above or anywhere else herein, can be cleavably fused within the XTEN polypeptide and releasable (configured to be released) from the XTEN polypeptide upon digestion of the polypeptide by a protease. In some embodiments, the protease is a Glu-C protease. In some embodiments, the protease cleaves on the C-terminal side of glutamic acid residues that are not followed by proline. One of ordinary skill in the art will understand that a barcoded XTEN polypeptide (an XTEN polypeptide that contains barcode fragment(s) therewithin) is designed to achieve high efficiency, precision and accuracy of the protease digestion. For example, one of ordinary skill in the art will understand that adjacent Glu-Glu (EE) residues in an XTEN sequence can result in varying cleavage patterns upon Glu-C digestion. Accordingly, when Glu-C protease is used for barcode release, the barcoded XTEN polypeptide or the barcode fragment(s) can be without any Glu-Glu (EE) sequence. One of ordinary skill in the art will also understand that a di-peptide Glu-Pro (EP) sequence, if present in the fusion polypeptide, can be incapable of cleavage by Glu-C protease during the barcode release process.

Structural Configuration of BPXTEN

In some embodiments, a BPXTEN fusion protein comprises a single BP polypeptide and a single XTEN polypeptide. Such BPXTEN proteins can have at least the following permutations of configurations, each listed in an N- to C-terminus orientation: BP-XTEN; XTEN-BP; BP-S-XTEN; and XTEN-S-BP, wherein "S" is a spacer sequence as set forth below.

In some embodiments, the BPXTEN protein comprises a C-terminal XTEN polypeptide and, optionally, a spacer sequence (S) between the XTEN polypeptide and the BP polypeptide. Such BPXTEN protein can be represented by Formula I (depicted N- to C-terminus):

$$(BP)\text{—}(S)_x\text{-}(XTEN) \qquad (I),$$

wherein BP is a biologically active protein as described hereinbelow; S is a spacer sequence having between 1 to about 50 amino acid residues that can optionally include a BP release segment (as described more fully hereinbelow); x is either 0 or 1; and XTEN can be any XTEN polypeptide described herein.

In some embodiments, the BPXTEN protein comprises an N-terminal XTEN polypeptide and, optionally, a spacer sequence (S) between the XTEN polypeptide and the BP protein. Such BPXTEN proteins can be represented by Formula II (depicted N- to C-terminus):

$$(XTEN)\text{—}(S)_x\text{-}(BP) \qquad (II),$$

wherein BP is a biologically active protein as described hereinbelow; S is a spacer sequence having between 1 to about 50 amino acid residues that can optionally include a BP release segment (as described more fully hereinbelow); x is either 0 or 1; and XTEN can be any XTEN polypeptide as described herein.

Figure 2:
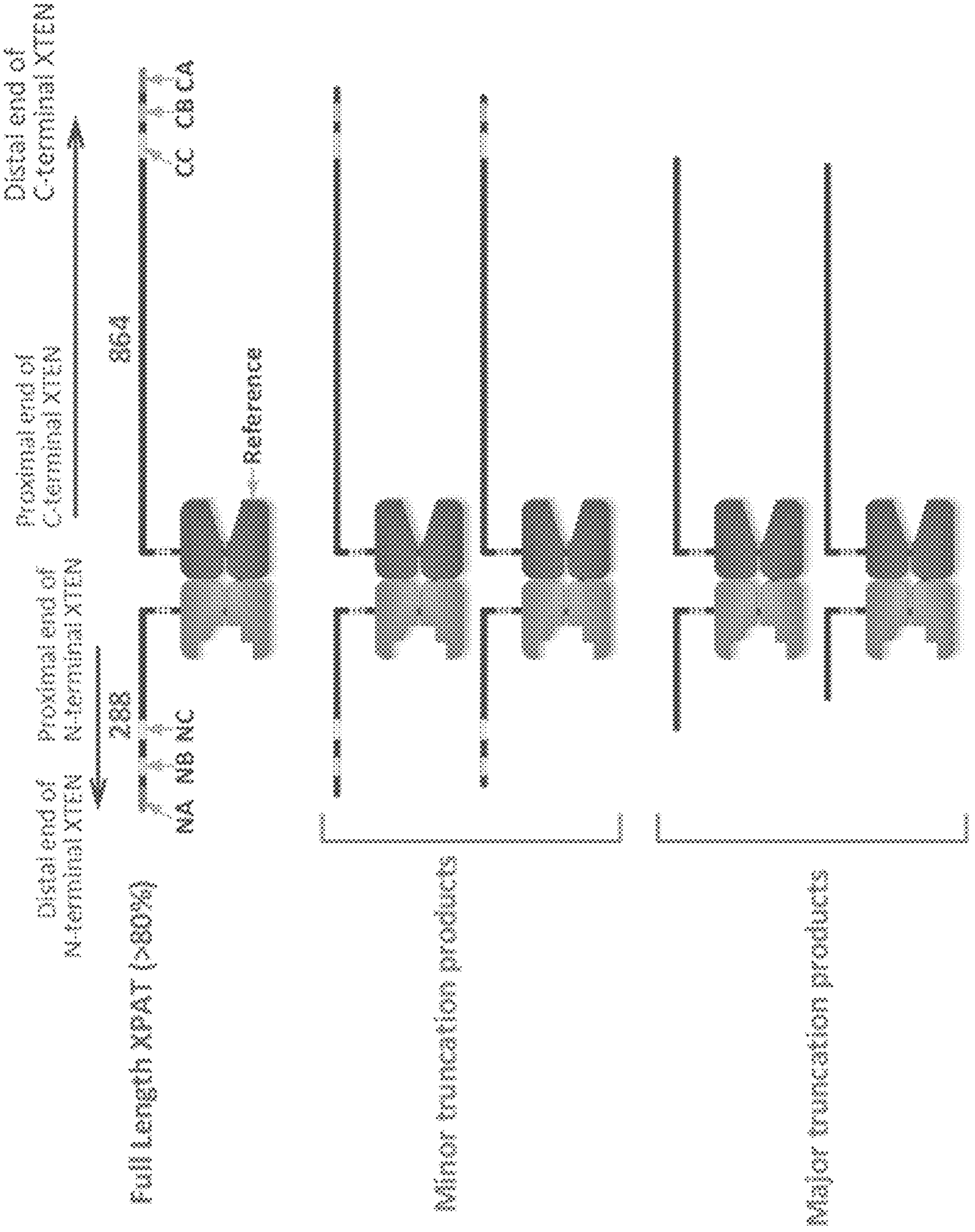
FIG. 2 depicts a mixture of XPAT polypeptides having varying lengths of barcoded XTEN polypeptides. In the full-length XPAT (top), the 288 amino acid-long N-terminal XTEN polypeptide contains three cleavably fused barcode sequences, "NA," "NB," and "NC" (from distal end to proximal end), and the 864 amino acid-long C-terminal XTEN polypeptide contains three cleavably fused barcode sequences, "CC," "CB," and "CA" (from proximal end to distal end). Each barcode is located to indicate a pharmacologically relevant length of the corresponding XTEN polypeptide. For example, minor N-terminal truncation products of the XPAT, lacking the barcode "NA" but having the more proximal barcodes "NB" and "NC," can show substantially the same pharmacological properties as the full-length construct. In contrast, major N-terminal truncation products of the XPAT, e.g., lacking all three barcodes on the N-terminus, can discernibly differ in pharmacological activity from the full-length construct. A unique proteolytically cleavable sequence is identified from the biologically active polypeptide (here, the tandem scFvs that comprise the active portion of the T-cell engager) of the XPAT. Due to its presence in all the length variants of the XPAT (including full-length XPAT, minor truncations, and major truncations thereof), the unique proteolytically cleavable sequence can be used as a reference for quantifying the amounts of various truncation products in relation to the total amount of the biologically active protein.
Figure 3:
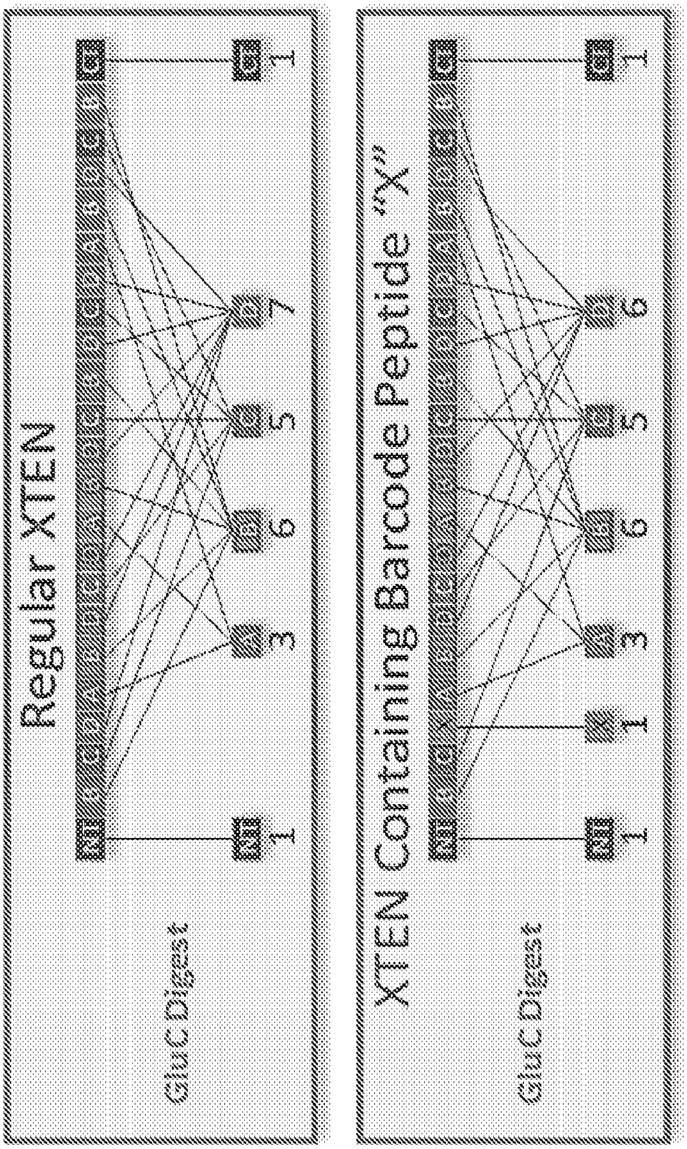
FIG. 3 illustrates a potential design for a barcoded XTEN polypeptide by inserting a barcode-generating sequence into a general-purpose (or regular) XTEN polypeptide. The exemplary general-purpose (or regular) XTEN polypeptide (top) comprises non-overlapping 12-mer motifs in the sequence "BCDABDCDABDCBDCDABDCB," wherein the sequence motifs "A," "B," "C," and "D" occur 3, 6, 5, and 7 times, respectively. Glu-C protease digest of the exemplary general-purpose XTEN polypeptide (upper panel) does not yield unique peptides except both termini ("NT" and "CT"). The insertion of a barcode-generating sequence, "X" (e.g., a unique 12-mer), into the XTEN polypeptide results in a unique proteolytically cleavable sequence (or barcode sequence) that does not occur anywhere else in the XTEN polypeptide. The barcode-generating sequence, "X," can be located wherein the resulting barcode marks a pharmacologically-relevant length of the XTEN polypeptide. For example, an XTEN polypeptide lacking a barcode can functionally differ from the corresponding XTEN polypeptide with the barcode. One of ordinary skill in the art will understand that the barcode-generating sequence ("X") can be the barcode sequence itself. Alternatively, the barcode-generating sequence ("X") can differ from the resulting barcode sequence. For example, the barcode sequence can overlap with and, thus, contain part of the preceding or following 12-mer motif.
Figure 4A:
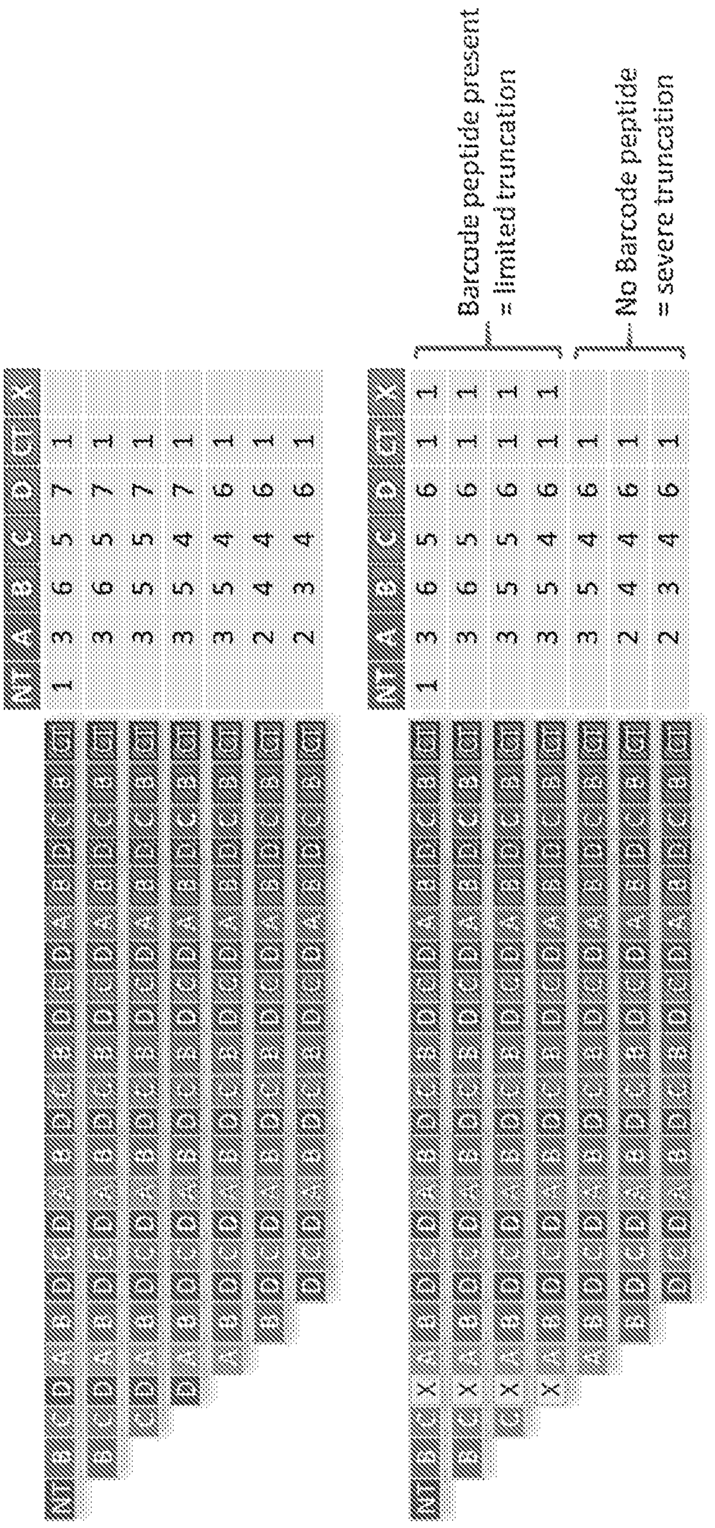
FIGS. 4A-4B illustrate the quantification of the level of truncation for an N-terminal XTEN polypeptide.
Figure 4B:
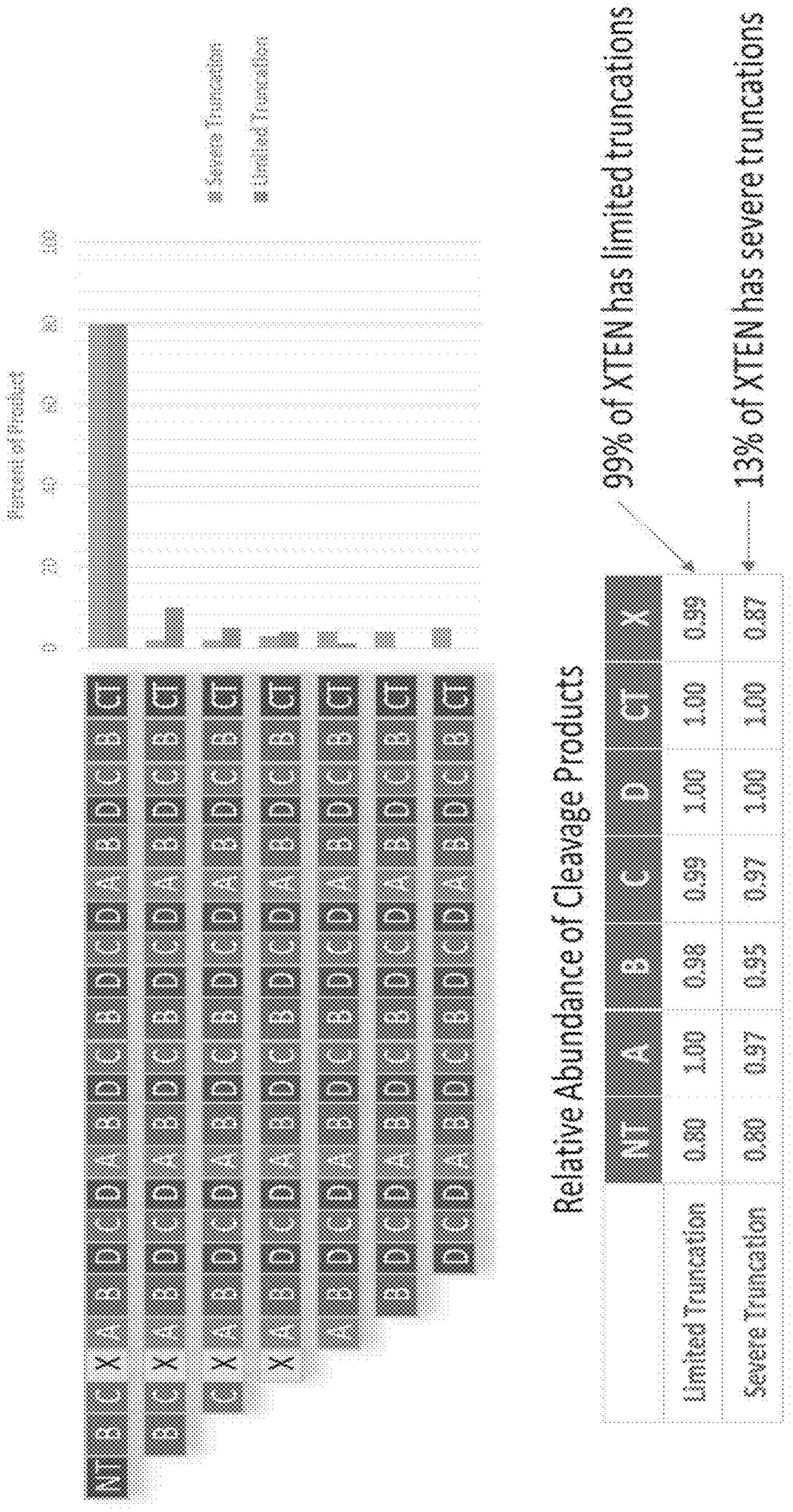

In some embodiment, the BPXTEN protein comprises both an N-terminal XTEN polypeptide and a C-terminal XTEN polypeptide. Such BPXTEN proteins (e.g., the XPATs in FIGS. 1-2) can be represented by Formula III:

$$(XTEN)\text{—}(S)_y\text{-}(BP)\text{—}(S)_z\text{-}(XTEN) \qquad (III)$$

wherein BP is a biologically active protein as described hereinbelow; S is a spacer sequence having between 1 to about 50 amino acid residues that can optionally include a BP release segment (as described more fully hereinbelow); y is either 0 or 1; z is either 0 or 1; and XTEN can be any XTEN polypeptide as described herein.

Biologically Active Polypeptide

A biologically active protein (BP) that can be fused to one or more XTEN polypeptides (as described herein), particularly those disclosed hereinbelow, comprising sequences identified herein by Tables 4a-4h and Tables 6a-6f, together with their corresponding nucleic acid and amino acid sequences, are well known in the art. Descriptions and sequences of these BP are available in public databases such as Chemical Abstracts Services Databases (e.g., the CAS Registry), GenBank, The Universal Protein Resource (UniProt) and subscription provided databases such as GenSeq (e.g., Derwent). Polynucleotide sequences encoding BPs can be wildtype polynucleotide sequences encoding a native BP (e.g., either full length or mature), or in some instances the sequence can be a variant of a wildtype polynucleotide sequence (e.g., a polynucleotide which encodes the wildtype, biologically active protein), wherein the nucleotide sequence of the polynucleotide has been optimized, for example, for expression in a particular species; or a polynucleotide encoding a variant of the wildtype protein, such as a site-directed mutant or an allelic variant. It is well within the ability of the skilled artisan to use a wildtype or consensus cDNA sequence or a codon-optimized variant of a BP to create BPXTEN constructs contemplated by the invention using methods known in the art and/or in conjunction with the guidance and methods provided herein.

BP for inclusion in BPXTEN proteins disclosed herein (for example, a fusion polypeptide comprising at least one BP and at least one XTEN polypeptide) can include any protein of biologic, therapeutic, prophylactic, or diagnostic interest or function, or that is useful for mediating a biological activity or preventing or ameliorating a disease, disorder or conditions when administered to a human or animal. Particularly advantageous are BP for which an increase in a pharmacokinetic parameter, increased solubility, increased stability, masking of activity, or some other enhanced pharmaceutical property is sought, or those BP for which increasing the terminal half-life would improve efficacy, safety, or result in reduce dosing frequency and/or improve patient compliance. Thus, BPXTEN fusion protein compositions can be prepared with various objectives in mind, including improving therapeutic efficacy of the bioactive compound by, for example, increasing in vivo exposure or the length of time that the BPXTEN remains within the therapeutic window when administered to a human or animal compared to a BP not linked to an XTEN polypeptide.

A BP can be a native, full-length protein or can be a fragment or a sequence variant of a biologically active protein that retains at least a portion of the biological activity of the native protein.

In one embodiment, the BP incorporated into the human or animal compositions can be a recombinant polypeptide with a sequence corresponding to a protein found in nature. In another embodiment, the BP can be sequence variants, fragments, homologs, and mimetics of a natural sequence that retain at least a portion of the biological activity of the native BP. In non-limiting examples, a BP can be a sequence that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a protein sequence selected from Tables 4a-4h. In further non-limiting examples, a BP can be a bispecific sequence comprising a first binding domain and a second binding domain, wherein the first binding domain, having specific binding affinity to a tumor-specific marker or an antigen of a target cell, exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to paired VL and VH sequences of an anti-CD3 antibody identified in Table 6f; and wherein the second binding domain, having specific binding affinity to an effector cell, exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to paired VL and VH sequences of an anti-target cell antibody identified in Table 6a. In one embodiment, a BPXTEN fusion protein can comprise a single BP protein linked to an XTEN polypeptide. In another embodiment, the BPXTEN protein can comprise a first BP and a second molecule of the same BP, resulting in a fusion protein comprising the two BP linked to one or more XTEN polypeptides (for example, two molecules of glucagon, or two molecules of hGH).

In general, BP exhibits a binding specificity to a given target (or a given number of targets) or another desired biological characteristic when used in vivo or when utilized in an in vitro assay. For example, the BP can be an agonist, a receptor, a ligand, an antagonist, an enzyme, an antibody (e.g., mono- or bi-specific), or a hormone. Of particular interest are BP used or known to be useful for a disease or disorder wherein the native BP have a relatively short terminal half-life and for which an enhancement of a pharmacokinetic parameter (which optionally could be released from the fusion protein by cleavage of a spacer sequence) would permit less frequent dosing or an enhanced pharmacologic effect. Also of interest are BP that have a narrow therapeutic window between the minimum effective dose or blood concentration (Cmin) and the maximum tolerated dose or blood concentration (Cmax). In such cases, the linking of the BP to a fusion protein comprising a select XTEN polypeptide sequence(s) can result in an improvement in these properties, making them more useful as therapeutic or preventive agents compared to BP not linked to one or more XTEN polypeptides.

Glucose-Regulating Peptides

Endocrine and obesity-related diseases or disorders have reached epidemic proportions in most developed nations, and represent a substantial and increasing health care burden in most developed nations, which include a large variety of conditions affecting the organs, tissues, and circulatory system of the body. Of particular concern are endocrine and obesity-related diseases and disorders, chief amongst which is diabetes, one of the leading causes of death in the United States.

Most metabolic processes in glucose homeostasis and insulin response are regulated by multiple peptides and hormones, and many such peptides and hormones, as well as analogues thereof, have found utility in the treatment of metabolic diseases and disorders. Many of these peptides tend to be highly homologous to each other, even when they possess opposite biological functions. Glucose-increasing peptides are exemplified by the peptide hormone glucagon, while glucose-lowering peptides include exendin-4, glucagon-like peptide 1, and amylin. However, the use of therapeutic peptides and/or hormones, even when augmented by the use of small molecule drugs, has met with limited success in the management of such diseases and disorders. In particular, dose optimization is important for drugs and biologics used in the treatment of metabolic diseases, especially those with a narrow therapeutic window. Hormones in general, and peptides involved in glucose homeostasis often have a narrow therapeutic window. The narrow therapeutic window, coupled with the fact that such hormones and peptides typically have a short half-life, which necessitates frequent dosing in order to achieve clinical benefit, results in difficulties in the management of such patients. While chemical modifications to a therapeutic protein, such as pegylation, can modify its in vivo clearance rate and subsequent serum half-life, it requires additional manufacturing steps and results in a heterogeneous final product. In addition, unacceptable side effects from chronic administration have been reported. Alternatively, genetic modification by fusion of an Fc domain to the therapeutic protein or peptide increases the size of the therapeutic protein, reducing the rate of clearance through the kidney, and promotes recycling from lysosomes by the FcRn receptor. Unfortunately, the Fc domain does not fold efficiently during recombinant expression and tends to form insoluble precipitates known as inclusion bodies. These inclusion bodies must be solubilized and functional protein must be renatured; a time-consuming, inefficient, and expensive process.

Thus, one aspect of the present invention is the incorporation of peptides involved in glucose homeostasis, insulin resistance and obesity (collectively, "glucose regulating peptides") in BPXTEN fusion proteins to create compositions with utility in the treatment of glucose, insulin, and obesity disorders, disease and related conditions. Suitable glucose-regulating peptides that can be linked to XTEN polypeptides disclosed herein to create BPXTEN proteins that include all biologically active polypeptides, inter alia, that increase glucose-dependent secretion of insulin by pancreatic beta-cells or potentiate the action of insulin. Glucose-regulating peptides can also include biologically active polypeptides that stimulate pro-insulin gene transcription in the pancreatic beta-cells. Furthermore, glucose-regulating peptides can also include biologically active polypeptides that slow down gastric emptying time and reduce food intake. Glucose-regulating peptides can also include biologically active polypeptides that inhibit glucagon release from the alpha cells of the Islets of Langerhans. Table 4a provides a nonlimiting list of sequences of glucose-regulating peptides that can be encompassed by BPXTEN fusion proteins of the invention. Glucose regulating peptides of the inventive BPXTEN compositions disclosed herein can be a peptide that exhibits at least about 80% sequence identity (e.g., 81%, 82%, 83%, 84%, 85%, 86%, 87%, 88%, 89%, 90%, 91%, 92%, 93%, 94%, 95%, 96%, 97%, 98%, 99%, or 100% sequence identity) to an amino acid sequence selected from Table 4a.

TABLE 4a

| Glucose-Regulating Peptides | | |
|---|---|---|
| Name of Protein (Synonym) | SEQ ID NO | Amino Acid Sequence |
| Adrenomedullin (ADM) | 1 | YRQSMNNFQGLRSFGCRFGTCTVQKLAHQIYQFTDKDKDNVAPRSKIS PQGY |
| Amylin, rat | 2 | KCNTATCATQRLANFLVRSSNNLGPVLPPTNVGSNTY |
| Amylin, human | 3 | KCNTATCATQRLANFLVHSSNNFGAILSSTNVGSNTY |
| Calcitonin (hCT) | 4 | CGNLSTCMLGTYTQDFNKFHTFPQTAIGVGAP |
| Calcitonin, salmon | 5 | CSNLSTCVLGKLSQELHKLQTYPRTNTGSGTP |
| Calcitonin gene related peptide (h-CGRP α) | 6 | ACDTATCVTHRLAGLLSRSGGVVKNMVPTNVGSKAF |
| Calcitonin gene related peptide (h-CGRP β) | 7 | ACNTATCVTHRLAGLLSRSGGMVKSNFVPTNVGSKAF |
| cholecystokinin (CCK) | 8 | MNSGVCLCVLMAVLAAGALTQPVPPADPAGSGLQRAEEAPRRQLRVS QRTDGESRAHLGALLARYIQQARKAPSGRMSIVKNLQNLDPSHRISDR DYMGWMDFGRRSAEEYEYPS |
| CCK-33 | 9 | KAPSGRMSIVKNLQNLDPSHRISDRDYMGWMDF |
| CCK-8 | 10 | DYMGWMDF |
| Exendin-3 | 11 | HSDGTFTSDLSKQMEEEAVRLFIEWLKNGGPSSGAPPPS |
| Exendin-4 | 12 | HGEGTFTSDLSKQMEEEAVRLFIEWLKNGGPSSGAPPPS |
| FGF-19 | 13 | MRSGCVVVHVWILAGLWLAVAGRPLAFSDAGPHVHYGWGDPIRLRH LYTSGPHGLSSCFLRIRADGVVDCARGQSAHSLLEIKAVALRTVAIKGV HSVRYLCMGADGKMQGLLQYSEEDCAFEEEIRPDGYNVYRSEKHRLP VSLSSAKQRQLYKNRGFLPLSHFLPMLPMVPEEPEDLRGHLESDMFSSP LETDSMDPFGLVTGLEAVRSPSFEK |
| FGF-21 | 14 | MDSDETGFEHSGLWVSVLAGLLLGACQAHPIPDSSPLLQFGGQVRQRY LYTDDAQQTEAHLEIREDGTVGGAADQSPESLLQLKALKPGVIQILGV KTSRFLCQRPDGALYGSLHFDPEACSFRELLLEDGYNVYQSEAHGLPL HLPGNKSPHRDPAPRGPARFLPLPGLPPALPEPPGILAPQPPDVGSSDPL SMVGPSQGRSPSYAS |
| Gastrin | 15 | QLGPQGPPHLVADPSKKQGPWLEEEEEAYGWMDF |
| Gastrin-17 | 16 | DPSKKQGPWLEEEEEAYGWMDF |
| Gastric inhibitory polypeptide (GIP) | 17 | YAEGTFISDYSIAMDKIHQQDFVNWLLAQKGKKNDWKHNITQ |
| Ghrelin | 18 | GSSFLSPEHQRVQQRKESKKPPAKLQPR |
| Glucagon | 19 | HSQGTFTSDYSKYLDSRRAQDFVQWLMNT |
| Glucagon-like peptide-1 (hGLP-1) (GLP-1; 1-37) | 20 | HDEFERHAEGTFTSDVSSTLEGQAALEFIAWLVKGRG |
| GLP-1 (7-36), human | 2 | HAEGTFTSDVSSYLEGQAALEFIAWLVKGR |
| GLP-1 (7-37), human | 22 | HAEGTFTSDVSSTLEGQAALEFIAWLVKGRG |
| GLP-1, frog | 23 | HAEGTYTNDVTEYLEEKAAKEFIEWLIKGKPKKIRYS |
| Glucagon-like peptide 2 (GLP-2), human | 24 | HADGSFSDEMNTILDNLAARDFINWLIETKITD |
| GLP-2, frog | 25 | HAEGTFTNDMTNYLEEKAAKEFVGWLIKGRP-OH |

TABLE 4a-continued

| Glucose-Regulating Peptides | | |
|---|---|---|
| Name of Protein (Synonym) | SEQ ID NO | Amino Acid Sequence |
| IGF-1 | 26 | GPETLCGAELVDALQFVCGDRGFYFNKPTGYGSSSRRAPQTGIVDECC FRSCDLRRLEMYCAPLKPAKSA |
| IGF-2 | 27 | AYRPSETLCGGELVDTLQFVCGDRGFYFSRPASRVSRRSRGIVEECCFR SCDLALLETYCATPAKSE |
| INGAP peptide (islet neogenesis-associated protein) | 28 | EESQKKLPSSRITCPQGSVAYGSYCYSLILIPQTWSNAELSCQMHFSGH LAFLLSTGEITFVSSLVKNSLTAYQYIWIGLHDPSHGTLPNGSGWKWSS SNVLTFYNWERNPSIAADRGYCAVLSQKSGFQKWRDFNCENELPYICK FKV |
| Intermedin (AFP-6) | 29 | TQAQLLRVGCVLGTCQVQNLSHRLWQLMGPAGRQDSAPVDPSSPHSY |
| Leptin, human | 30 | VPIQKVQDDTKTLIKTIVTRINDISHTQSVSSKQKVTGLDFIPGLHPILTL SKMDQTLAVYQQILTSMPSRNVIQISNDLENLRDLLHVLAFSKSCHLP WASGLETLDSLGGVLEASGYSTEVVALSRLQGSLQDMLWQLDLSPGC |
| Neuromedin (U-8) porcine | 31 | YFLFRPRN |
| Neuromedin (U-9) | 32 | GYFLFRPRN |
| neuromedin (U25) human) | 33 | FRVDEEFQSPFASQSRGYFLFRPRN |
| Neuromedin (U25) pig | 34 | FKVDEEFQGPIVSQNRRYFLFRPRN |
| Neuromedin S, human | 35 | ILQRGSGTAAVDFTKKDHTATWGRPFFLFRPRN |
| Neuromedin U, rat | 36 | YKVNEYQGPVAPSGGFFLFRPRN |
| oxyntomodulin (OXM) | 37 | HSQGTFTSDYSKYLDSRRAQDFVQWLMNTKRNRNNIA |
| Peptide YY (PYY) | 38 | YPIKPEAPGEDASPEELNRYYASLRHYLNLVTRQRY |
| Pramlintide | 39 | KCNTATCATNRLANFLVHSSNNFGPILPPTNVGSNTY-NH2 |
| Urocortin (Ucn-1) | 40 | DNPSLSIDLTFHLLRTLLELARTQSQRERAEQNRIIFDSV |
| Urocortin (Ucn-2) | 41 | IVLSLDVPIGLLQILLEQARARAAREQATTNARILARVGHC |
| Urocortin (Ucn-3) | 42 | FTLSLDVPTNIMNLLFNIAKAKNLRAQAAANAHLMAQI |

"Adrenomedullin" or "ADM" means the human adrenomedulin peptide hormone and species and sequence variants thereof having at least a portion of the biological activity of mature ADM. ADM is generated from a 185 amino acid preprohormone through consecutive enzymatic cleavage and amidation, resulting in a 52 amino acid bioactive peptide with a measured plasma half-life of 22 min. ADM-containing fusion proteins of the invention can find particular use in diabetes for stimulatory effects on insulin secretion from islet cells for glucose regulation or in human or animals with sustained hypotension. The complete genomic infrastructure for human AM has been reported (Ishimitsu et al., 1994, Biochem. Biophys. Res. Commun 203:631-639), and analogs of ADM peptides have been cloned, as described in U.S. Pat. No. 6,320,022.

"Amylin" means the human peptide hormone referred to as amylin, pramlintide, and species variations thereof, as described in U.S. Pat. No. 5,234,906, having at least a portion of the biological activity of mature amylin. Amylin is a 37-amino acid polypeptide hormone co-secreted with insulin by pancreatic beta cells in response to nutrient intake (Koda et al., 1992, Lancet 339:1179-1180), and has been reported to modulate several key pathways of carbohydrate metabolism, including incorporation of glucose into glycogen. Amylin-containing fusion proteins of the invention can complement the action of insulin, which regulates the rate of glucose disappearance from the circulation and its uptake by peripheral tissues. Amylin analogues have been cloned, as described in U.S. Pat. Nos. 5,686,411 and 7,271,238.

Amylin mimetics can be created that retain biologic activity. For example, pramlintide has the sequence KCNTATCATNRLANFLVHSSNNFGPILPPTNVGSNTY (SEQ ID NO: 43), wherein amino acids from the rat amylin sequence are substituted for amino acids in the human amylin sequence. In one embodiment, the invention contemplates fusion proteins comprising amylin mimetics of the sequence KCNTATCAT$X_1$RLANFLVHSSNNFG$X_2$ IL$X_2X_2$TNVGSNTY (SEQ ID NO: 44) wherein $X_1$ is independently N or Q and $X_2$ is independently S, P or G. In one embodiment, the amylin mimetic incorporated into a BPXTEN can have the sequence KCNTATCATNRLANFLVHSSNNFGGILGGTNVGSNTY (SEQ ID NO: 45). In another embodiment, wherein the amylin mimetic is used at the C-terminus of the BPXTEN, the mimetic can have the sequence KCNTATCATNRLANFLVHSSNNFGGILGGTNVGSNTY($NH_2$) (SEQ ID NO: 46).

"Calcitonin" (CT) means the human calcitonin protein and species and sequence variants thereof, including salmon calcitonin ("sCT"), having at least a portion of the biological activity of mature CT. CT is a 32 amino acid peptide cleaved from a larger prohormone of the thyroid that appears to function in the nervous and vascular systems, but has also been reported to be a potent hormonal mediator of the satiety reflex. (Reviewed in Becker, JCEM, 89(4): 1512-1525 (2004) and Sexton, Current Medicinal Chemistry 6: 1067-1093 (1999)). Calcitonin-containing fusion proteins of the invention can find particular use for the treatment of osteoporosis and as a therapy for Paget's disease of bone. Synthetic calcitonin peptides have been created, as described in U.S. Pat. Nos. 5,175,146 and 5,364,840.

"Calcitonin gene related peptide" or "CGRP" means the human CGRP peptide and species and sequence variants thereof having at least a portion of the biological activity of mature CGRP, which is a member of the calcitonin family of peptides, which in humans exists in two forms, α-CGRP (a 37 amino acid peptide) and β-CGRP. CGRP has 43-46% sequence identity with human amylin. CGRP-containing fusion proteins of the invention can find particular use in decreasing morbidity associated with diabetes, ameliorating hyperglycemia and insulin deficiency, inhibition of lymphocyte infiltration into the islets, and protection of beta cells against autoimmune destruction. Methods for making synthetic and recombinant CGRP are described in U.S. Pat. No. 5,374,618.

"Cholecystokinin" or "CCK" means the human CCK peptide and species and sequence variants thereof having at least a portion of the biological activity of mature CCK. CCK-58 is the mature sequence, while the CCK-33 amino acid sequence first identified in humans is the major circulating form of the peptide. The CCK family also includes an 8-amino acid in vivo C-terminal fragment ("CCK-8"), pentagastrin or CCK-5 being the C-terminal peptide CCK(29-33), and CCK-4 being the C-terminal tetrapeptide CCK(30-33). CCK is a peptide hormone of the gastrointestinal system responsible for stimulating the digestion of fat and protein. CCK-33 and CCK-8-containing fusion proteins of the invention can find particular use in reducing the increase in circulating glucose after meal ingestion and potentiating the increase in circulating insulin. Analogues of CCK-8 have been prepared, as described in U.S. Pat. No. 5,631,230.

"Exendin-3" means a glucose regulating peptide isolated from Heloderma horridum and sequence variants thereof having at least a portion of the biological activity of mature exendin-3. Exendin-3 amide is a specific exendin receptor antagonist from that mediates an increase in pancreatic cAMP, and release of insulin and amylase. Exendin-3-containing fusion proteins of the invention can find particular use in the treatment of diabetes and insulin resistance disorders. The sequence and methods for its assay are described in U.S. Pat. No. 5,424,286.

Exendin-4" means a glucose regulating peptide found in the saliva of the Gila-monster Heloderma suspectum, as well as species and sequence variants thereof, and includes the native 39 amino acid sequence HGEGTFTSDLSKQMEEE-AVRLFIEYLKNGGPSSGAPPPS (SEQ ID NO: 47) and homologous sequences and peptide mimetics, and variants thereof; natural sequences, such as from primates and non-natural having at least a portion of the biological activity of mature exendin-4. Exendin-4 is an incretin polypeptide hormone that decreases blood glucose, promotes insulin secretion, slows gastric emptying and improves satiety, providing a marked improvement in postprandial hyperglycemia. Table 4b shows the sequences from a wide variety of species, while Table 4c shows a list of synthetic GLP-1 analogs; all of which are contemplated for use in the BPXTEN proteins described herein.

Fibroblast growth factor 21, or "FGF-21" means the human protein encoded by the FGF-21 gene, or species and sequence variants thereof having at least a portion of the biological activity of mature FGF-21. FGF-21 stimulates glucose uptake in adipocytes but not in other cell types; the effect is additive to the activity of insulin. FGF-21-containing fusion proteins of the invention can find particular use in treatment of diabetes, including causing increased energy expenditure, fat utilization and lipid excretion. FGF-21 has been cloned, as disclosed in U.S. Pat. No. 6,716,626.

"Fibroblast growth factor 19," or "FGF-19" means the human protein encoded by the FGF-19 gene, or species and sequence variants thereof having at least a portion of the biological activity of mature FGF-19. FGF-19 is a protein member of the fibroblast growth factor (FGF) family. FGF-19 increases liver expression of the leptin receptor, metabolic rate, stimulates glucose uptake in adipocytes, and leads to loss of weight in an obese mouse model (Fu et al., 2004, Endocrinology 145: 2504-2603) FGF-19-containing fusion proteins of the invention can find particular use in increasing metabolic rate and reversal of dietary and leptin-deficient diabetes. FGF-19 has been cloned and expressed, as described in US Patent Application No. 20020042367.

"Gastrin" means the human gastrin peptide, truncated versions, and species and sequence variants thereof having at least a portion of the biological activity of mature gastrin. Gastrin is found primarily in three forms: gastrin-34 ("big gastrin"); gastrin-17 ("little gastrin"); and gastrin-14 ("minigastrin") and shares sequence homology with CCK. Gastrin-containing fusion proteins of the invention can find particular use in the treatment of obesity and diabetes for glucose regulation. Gastrin has been synthesized, as described in U.S. Pat. No. 5,843,446.

"Ghrelin" means a human hormone that induces satiation, or species and sequence variants thereof, including the native, processed 27 or 28 amino acid sequence and homologous sequences. Ghrelin levels increase before meals and decrease after meals, and can result in increased food intake and increase fat mass by an action exerted at the level of the hypothalamus. Ghrelin-containing fusion proteins of the invention can find particular use as agonists; e.g., to selectively stimulate motility of the GI tract in gastrointestinal motility disorder, to accelerate gastric emptying, or to stimulate the release of growth hormone. Ghrelin analogs with sequence substitutions or truncated variants, such as described in U.S. Pat. No. 7,385,026, can find particular use as fusion partners with XTEN polypeptides for use as antagonists for improved glucose homeostasis, treatment of insulin resistance and treatment of obesity. The isolation and characterization of ghrelin has been reported (Kojima et al., 1999, Nature. 402:656-660) and synthetic analogs have been prepared by peptide synthesis, as described in U.S. Pat. No. 6,967,237.

"Glucagon" means the human glucagon glucose regulating peptide, or species and sequence variants thereof, including the native 29 amino acid sequence and homologous sequences; natural, such as from primates, and non-natural sequence variants having at least a portion of the biological activity of mature glucagon. The term "glucagon" as used herein also includes peptide mimetics of glucagon. Glucagon-containing fusion proteins of the invention can find particular use in increasing blood glucose levels in individuals with extant hepatic glycogen stores and maintaining glucose homeostasis in diabetes. Glucagon has been cloned, as disclosed in U.S. Pat. No. 4,826,763.

"GLP-1" means human glucagon like peptide-1 and sequence variants thereof having at least a portion of the biological activity of mature GLP-1. The term "GLP-1" includes human GLP-1(1-37), GLP-1(7-37), and GLP-1(7-36)amide. GLP-1 stimulates insulin secretion, but only during periods of hyperglycemia. The safety of GLP-1 compared to insulin is enhanced by this property and by the observation that the amount of insulin secreted is proportional to the magnitude of the hyperglycemia. The biological half-life of GLP-1(7-37)OH is a mere 3 to 5 minutes (U.S. Pat. No. 5,118,666). GLP-1-containing fusion proteins of the invention can find particular use in the treatment of diabetes and insulin-resistance disorders for glucose regulation. GLP-1 has been cloned and derivatives prepared, as described in U.S. Pat. No. 5,118,666. Non-limited examples of GLP-1 sequences from a wide variety of species are shown in Table 4b, while Table 4c shows the sequences of a number of synthetic GLP-1 analogs; all of which are contemplated for use in the BPXTEN compositions described herein.

TABLE 4b

Representative Naturally-Occurring GLP-1 Homologs as BP Candidates

| Gene Name | SEQ ID NO | Amino Acid Sequence |
|---|---|---|
| GLP-1 {frog} | 48 | HAEGTYTNDVTEYLEEKAAKEFIEWLIKGKPKKIRYS |
| GLP-1a {*Xenopus laevis*} | 49 | HAEGTFTSDVTQQLDEKAAKEFIDWLINGGPSKEIIS |
| GLP-1b {*Xenopus laevis*} | 50 | HAEGTYTNDVTEYLEEKAAKEFIIEWLIKGKPK |
| GLP-1c {*Xenopus laevis*} | 51 | HAEGTFTNDMTNYLEEKAAKEFVGWLIKGRPK |
| Gastric Inhibitory Polypeptide {*Mus musculus*} | 52 | HAEGTFISDYSIAMDKIRQQDFVNWLL |
| Glucose-dependent insulinotropic polypeptide {*Equus caballus*} | 53 | HAEGTFISDYSIAMDKIRQQDFVNWLL |
| Glucagon-like peptide {*Petromyzon marinus*} | 54 | HADGTFTNDMTSYLDAKAARDFVSWLARSDKS |
| Glucagon-like peptide {*Anguilla rostrata*} | 55 | HAEGTYTSDVSSYLQDQAAKEFVSWLKTGR |
| Glucagon-like peptide {*Anguilla anguilla*} | 56 | HAEGTYTSDVSSYLQDQAAKEFVSWLKTGR |
| Glucagon-like peptide {*Hydrolagus colliei*} | 57 | HADGIYTSDVASLTDYLKSKRFVESLSNYNKRQNDRRM |
| Glucagon-like peptide {*Amia calva*} | 58 | YADAPYISDVYSYLQDQVAKKWLKSGQDRRE |
| GLUC_ICTPU/38-65 | 59 | HADGTYTSDVSSYLQEQAAKDFITWLKS |
| GLUCL_ANGRO/1-28 | 60 | HAEGTYTSDVSSYLQDQAAKEFVSWLKT |
| GLUC_BOVIN/98-125 | 61 | HAEGTFTSDVSSYLEGQAAKEFIAWLVK |
| GLUC1_LOPAM/91-118 | 62 | HADGTFTSDVSSYLKDQAIKDFVDRLKA |
| GLUCL_HYDCO/1-28 | 63 | HADGIYTSDVASLTDYLKSKRFVESLSN |
| GLUC_CAVPO/53-80 | 64 | HSQGTFTSDYSKYLDSRRAQQFLKWLLN |
| GLUC_CHIBR/1-28 | 65 | HSQGTFTSDYSKHLDSRYAQEFVQWLMN |
| GLUC1_LOPAM/53-80 | 66 | HSEGTFSNDYSKYLEDRKAQEFVRWLMN |
| GLUC_HYDCO/1-28 | 67 | HTDGIFSSDYSKYLDNRRTKDFVQWLLS |
| GLUC_CALMI/1-28 | 68 | HSEGTFSSDYSKYLDSRRAKDFVQWLMS |
| GIP_BOVIN/1-28 | 69 | YAEGTFISDYSIAMDKIRQQDFVNWLLA |
| VIP_MELGA/89-116 | 70 | HADGIFTTVYSHLLAKLAVKRYLHSLIR |
| PACA_CHICK/131-158 | 71 | HIDGIFTDSYSRYRKQMAVKKYLAAVLG |
| VIP_CAVPO/45-72 | 72 | HSDALFTDTYTRLRKQMAMKKYLNSVLN |
| VIP_DIDMA/1-28 | 73 | HSDAVFTDSYTRLLKQMAMRKYLDSILN |
| EXE1_HELSU/1-28 | 74 | HSDATFTAEYSKLLAKLALQKYLESILG |
| SLIB_CAPHI/1-28 | 75 | YADAIFTNSYRKVLGQLSARKLLQDIMN |

TABLE 4b-continued

| Representative Naturally-Occurring GLP-1 Homologs as BP Candidates | | |
|---|---|---|
| Gene Name | SEQ ID NO | Amino Acid Sequence |
| SLIB_RAT/31-58 | 76 | HADAIFTSSYRRILGQLYARKLLHEIMN |
| SLIB_MOUSE/31-58 | 77 | HVDAIFTTNYRKLLSQLYARKVIQDIMN |
| PACA_HUMAN/83-110 | 78 | VAHGILNEAYRKVLDQLSAGKHLQSLVA |
| PACA_SHEEP/83-110 | 79 | VAHGILDKAYRKVLDQLSARRYLQTLMA |
| PACA_ONCNE/82-109 | 80 | HADGMFNKAYRKALGOLSARKYLHSLMA |
| GLUC_BOVIN/146-173 | 81 | HADGSFSDEMNTVLDSLATRDFINWLLQ |
| SECR_CANFA/1-27 | 82 | HSDGTFTSELSRLRESARLQRLLOGLV |
| SECR_CHICK/1-27 | 8 | HSDGLFTSEYSKMRGNAQVQKFIQNLM |
| EXE3_HELHO/48-75 | 84 | HSDGTFTSDLSKQMEEEAVRLFIEWLKN |

TABLE 4c

| Representative GLP-1 Synthetic Analogs | |
|---|---|
| SEQ ID NO | Amino Acid Sequence |
| 85 | HAEGTFTSDVSSYLEGQAAREFIAWLVKGRG |
| 86 | HAEGTFTSDVSSYLEGQAAKEFIAWLVRGRG |
| 87 | HAEGTFTSDVSSYLEGQAAKEFIAWLVKGKG |
| 88 | HAEGTFTSDVSSYLEGQAAREFIAWLVRGKG |
| 89 | HAEGTFTSDVSSYLEGQAAREFIAWLVRGKGR |
| 90 | HAEGTFTSDVSSYLEGQAAREFIAWLVRGRGRK |
| 91 | HAEGTFTSDVSSYLEGQAAREFIAWLVRGRGRRK |
| 92 | HAEGTFTSDVSSYLEGQAAREFIAWLVKGKG |
| 93 | HAEGTFTSDVSSYLEGQAAKEFIAWLVRGKG |
| 94 | HAEGTFTSDVSSYLEGQAAREFIAWLVKGRGRK |
| 95 | HAEGTFTSDVSSYLEGQAAKEFIAWLVRGRGRRK |
| 96 | HAEGTFTSDVSSYLEGQAAREFIAWLVRGKGRK |
| 97 | HAEGTFTSDVSSYLEGQAAREFIAWLVRGKGRRK |
| 98 | HGEGTFTSDVSSYLEGQAAREFIAWLVKGRG |
| 99 | HGEGTFTSDVSSYLEGQAAKEFIAWLVRGRG |
| 100 | HGEGTFTSDVSSYLEGQAAKEFIAWLVKGKG |
| 101 | HGEGTFTSDVSSYLEGQAAREFIAWLVRGKG |
| 102 | HGEGTFTSDVSSYLEGQAAREFIAWLVRGRGRK |
| 103 | HGEGTFTSDVSSYLEGQAAREFIAWLVRGRGRRK |
| 104 | HGEGTFTSDVSSYLEGQAAREFIAWLVKGKG |
| 105 | HGEGTFTSDVSSYLEGQAAKEFIAWLVRGKG |
| 106 | HGEGTFTSDVSSYLEGQAAREFIAWLVKGRGRK |
| 107 | HGEGTFTSDVSSYLEGQAAKEFIAWLVRGRGRRK |
| 108 | HGEGTFTSDVSSYLEGQAAREFIAWLVRGKGRK |

TABLE 4c-continued

| Representative GLP-1 Synthetic Analogs | |
|---|---|
| SEQ ID NO | Amino Acid Sequence |
| 109 | HGEGTFTSDVSSYLEGQAAREFIAWLVRGKGRRK |
| 110 | HAEGTFTSDVSSYLEGQAAREFIAWLVRGRGK |
| 111 | HAEGTFTSDVSSYLEGQAAREFIAWLVRGRGRK |
| 112 | HAEGTFTSDVSSYLEGQAAREFIAWLVRGRGRRK |
| 113 | HAEGTFTSDVSSYLEGQAAREFIAWLVRGRGRREK |
| 114 | HAEGTFTSDVSSYLEGQAAREFIAWLVRGRGRREFK |
| 115 | HAEGTFTSDVSSYLEGQAAREFIAWLVRGRGRREFPK |
| 116 | HAEGTFTSDVSSYLEGQAAREFIAWLVRGRGRREFPEK |
| 117 | HAEGTFTSDVSSYLEGQAAREFIAWLVRGRGRREFPEEK |
| 118 | HDEFERHAEGTFTSDVSSYLEGQAAREFIAWLVRGRGK |
| 119 | HDEFERHAEGTFTSDVSSYLEGQAAREFIAWLVRGRGRK |
| 120 | HDEFERHAEGTFTSDVSSYLEGQAAREFIAWLVRGRGRRK |
| 121 | HDEFERHAEGTFTSDVSSYLEGQAAREFIAWLVRGRGRREK |
| 122 | HDEFERHAEGTFTSDVSSYLEGQAAREFIAWLVRGRGRREFK |
| 123 | HDEFERHAEGTFTSDVSSYLEGQAAREFIAWLVRGRGRREFPK |
| 124 | HDEFERHAEGTFTSDVSSYLEGQAAREFIAWLVRGRGRREFPEK |
| 125 | HDEFERHAEGTFTSDVSSYLEGQAAREFIAWLVRGRGRREFPEEK |
| 126 | DEFERHAEGTFTSDVSSYLEGQAAREFIAWLVRGRGRK |
| 127 | DEFERHAEGTFTSDVSSYLEGQAAREFIAWLVRGRGRRK |
| 128 | DEFERHAEGTFTSDVSSYLEGQAAREFIAWLVRGRGRREK |
| 129 | DEFERHAEGTFTSDVSSYLEGQAAREFIAWLVRGRGRREFK |
| 130 | DEFERHAEGTFTSDVSSYLEGQAAREFIAWLVRGRGRREFPK |
| 131 | DEFERHAEGTFTSDVSSYLEGQAAREFIAWLVRGRGRREFPEK |
| 132 | DEFERHAEGTFTSDVSSYLEGQAAREFIAWLVRGRGRREFPEEK |
| 133 | EFERHAEGTFTSDVSSYLEGQAAREFIAWLVRGRGK |
| 134 | EFERHAEGTFTSDVSSYLEGQAAREFIAWLVRGRGRK |
| 135 | EFERHAEGTFTSDVSSYLEGQAAREFIAWLVRGRGRRK |
| 136 | EFERHAEGTFTSDVSSYLEGQAAREFIAWLVRGRGRREK |
| 137 | EFERHAEGTFTSDVSSYLEGQAAREFIAWLVRGRGRREFK |
| 138 | EFERHAEGTFTSDVSSYLEGQAAREFIAWLVRGRGRREFPK |
| 139 | EFERHAEGTFTSDVSSYLEGQAAREFIAWLVRGRGRREFPEK |
| 140 | EFERHAEGTFTSDVSSYLEGQAAREFIAWLVRGRGRREFPEEK |
| 141 | FERHAEGTFTSDVSSYLEGQAAREFIAWLVRGRGK |
| 142 | FERHAEGTFTSDVSSYLEGQAAREFIAWLVRGRGRK |
| 143 | FERHAEGTFTSDVSSYLEGQAAREFIAWLVRGRGRRK |
| 144 | FERHAEGTFTSDVSSYLEGQAAREFIAWLVRGRGRREK |
| 145 | FERHAEGTFTSDVSSYLEGQAAREFIAWLVRGRGRREFK |
| 146 | FERHAEGTFTSDVSSYLEGQAAREFIAWLVRGRGRREFPK |

TABLE 4c-continued

Representative GLP-1 Synthetic Analogs

| SEQ ID NO | Amino Acid Sequence |
| --- | --- |
| 147 | FERHAEGTFTSDVSSYLEGQAAREFIAWLVRGRGRREFPEK |
| 148 | FERHAEGTFTSDVSSYLEGQAAREFIAWLVRGRGRREFPEEK |
| 149 | ERHAEGTFTSDVSSYLEGQAAREFIAWLVRGRGK |
| 150 | ERHAEGTFTSDVSSYLEGQAAREFIAWLVRGRGRK |
| 151 | ERHAEGTFTSDVSSYLEGQAAREFIAWLVRGRGRRK |
| 152 | ERHAEGTFTSDVSSYLEGQAAREFIAWLVRGRGRREK |
| 153 | ERHAEGTFTSDVSSYLEGQAAREFIAWLVRGRGRREFK |
| 154 | ERHAEGTFTSDVSSYLEGQAAREFIAWLVRGRGRREFPK |
| 155 | ERHAEGTFTSDVSSYLEGQAAREFIAWLVRGRGRREFPEK |
| 156 | ERHAEGTFTSDVSSYLEGQAAREFIAWLVRGRGRREFPEEK |
| 157 | RHAEGTFTSDVSSYLEGQAAREFIAWLVRGRGK |
| 158 | RHAEGTFTSDVSSYLEGQAAREFIAWLVRGRGRK |
| 159 | RHAEGTFTSDVSSYLEGQAAREFIAWLVRGRGRRK |
| 160 | RHAEGTFTSDVSSYLEGQAAREFIAWLVRGRGRREK |
| 16 | RHAEGTFTSDVSSYLEGQAAREFIAWLVRGRGRREFK |
| 162 | RHAEGTFTSDVSSYLEGQAAREFIAWLVRGRGRREFPK |
| 163 | RHAEGTFTSDVSSYLEGQAAREFIAWLVRGRGRREFPEK |
| 164 | RHAEGTFTSDVSSYLEGQAAREFIAWLVRGRGRREFPEEK |
| 165 | HDEFERHAEGTFTSDVSSYLEGQAAREFIAWLVKGRGK |
| 166 | HDEFERHAEGTFTSDVSSYLEGQAAKEFIAWLVRGRGK |
| 167 | HDEFERHAEGTFTSDVSSYLEGQAAREFIAWLVRGKGK |
| 168 | HAEGTFTSDVSSYLEGQAAREFIAWLVKGRGK |
| 169 | HAEGTFTSDVSSYLEGQAAKEFIAWLVRGRGK |
| 170 | HAEGTFTSDVSSYLEGQAAREFIAWLVRGKGK |
| 171 | HAEGTFTSDVSSYLEGQAAREFIAWLVRGRGK |
| 172 | HDEFERHAEGTFTSDVSSYLEGQAAREFIAWLVKGRGRK |
| 173 | HDEFERHAEGTFTSDVSSYLEGQAAKEFIAWLVRGRGRK |
| 174 | HDEFERHAEGTFTSDVSSYLEGQAAREFIAWLVRGKGRK |
| 175 | HAEGTFTSDVSSYLEGQAAREFIAWLVKGRGRK |
| 176 | HAEGTFTSDVSSYLEGQAAKEFIAWLVRGRGRK |
| 177 | HAEGTFTSDVSSYLEGQAAREFIAWLVRGKGRK |
| 178 | HGEGTFTSDVSSYLEGQAAREFIAWLVKGRGK |
| 179 | HGEGTFTSDVSSYLEGQAAREFIAWLVRGKGK |

GLP native sequences can be described by several sequence motifs, which are presented below. Letters in brackets represent acceptable amino acids at each sequence position: {HVY} {AGISTV} {DEHQ} {AG} {ILMPSTV} {FLY} {DINST} {ADEKNST} {ADENSTV} {LMVY} {ANRSTY} {EHIKNQRST} {AHILMQVY} {LMRT} {ADEGKQS} {ADEGKNQSY} {AEIKLMQR} {AKQRSVY} {{AILMQSTV} {GKQR} {DEKLQR} {FHLVWY} {ILV} {ADEGHIKNQRST} {ADEGNRSTW} {GILVW} {AIKLMQSV} {ADGIKNQRST} {GKRSY} (SEQ ID NO: 9399). In addition, synthetic analogs of GLP-1 can be useful as fusion partners to XTEN polypeptides to create BPXTEN protein with biological activity useful in treatment of glucose-related disorders.

"GLP-2" means human glucagon like peptide-2 and sequence variants thereof having at least a portion of the biological activity of mature GLP-2. More particularly, GLP-2 is a 33 amino acid peptide, co-secreted along with GLP-1 from intestinal endocrine cells in the small and large intestine.

"Insulin-like growth factor 1" or "IGF-1" means the human IGF-1 protein and species and sequence variants thereof having at least a portion of the biological activity of mature IGF-1. IGF-1 consists of 70 amino acids and is produced primarily by the liver as an endocrine hormone as well as in target tissues in a paracrine/autocrine fashion. IGF-1-containing fusion proteins of the invention can find particular use in the treatment of diabetes and insulin-resistance disorders for glucose regulation. IGF-1 has been cloned and expressed in *E. coli* and yeast, as described in U.S. Pat. No. 5,324,639.

"Insulin-like growth factor 2" or "IGF-2" means the human IGF-2 protein and species and sequence variants thereof having at least a portion of the biological activity of mature IGF-2. IGF-2 has been cloned, as described in Bell et al., 1985, Proc Natl Acad Sci USA. 82:6450-4.

"Islet neogenesis-associated protein" (INGAP), or "pancreatic beta cell growth factor" means the human INGAP peptide and species and sequence variants thereof having at least a portion of the biological activity of mature INGAP. INGAP-containing fusion proteins of the invention can find particular use in the treatment or prevention of diabetes and insulin-resistance disorders. INGAP has been cloned and expressed, as described in R Rafaeloff et al., 1997, J Clin Invest. 99(9): 2100-2109.

"Intermedin" or "AFP-6" means the human intermedin peptide and species and sequence variants thereof having at least a portion of the biological activity of mature intermedin. Intermedin treatment leads to blood pressure reduction both in normal and hypertensive human or animals, as well as the suppression of gastric emptying activity, and is implicated in glucose homeostasis. Intermedin-containing fusion proteins of the invention can find particular use in the treatment of diabetes, insulin-resistance disorders, and obesity. Intermedin peptides and variants have been cloned, as described in U.S. Pat. No. 6,965,013.

"Leptin" means the naturally occurring leptin from any species, as well as biologically active D-isoforms, or fragments and sequence variants thereof. Leptin-containing fusion proteins of the invention can find particular use in the treatment of diabetes for glucose regulation, insulin-resistance disorders, and obesity. Leptin has been cloned, as described in U.S. Pat. No. 7,112,659, and leptin analogs and fragments in U.S. Pat. Nos. 5,521,283, 5,532,336, PCT/US96/22308 and PCT/US96/01471.

"Neuromedin" means the neuromedin family of peptides including neuromedin U and S peptides, and sequence variants thereof. Included in the neuromedin U family are various truncated or splice variants, e.g., FLFHYSKTQKLGKSNVVEELQSPFASQSRGYFLFRPRN (SEQ ID NO: 180). Exemplary of the neuromedin S family is human neuromedin S with the sequence ILQRGSGTAAVDFTKKDHTATWGRPFFLFRPRN (SEQ ID NO: 181), particularly its amide form. Neuromedin fusion proteins of the invention can find particular use in treating obesity, diabetes, reducing food intake, and other related conditions and disorders as described herein.

"Oxyntomodulin", or "OXM" means human oxyntomodulin and species and sequence variants thereof having at least a portion of the biological activity of mature OXM. OXM is a 37 amino acid peptide produced in the colon that contains the 29 amino acid sequence of glucagon followed by an 8 amino acid carboxyterminal extension. OXM-containing fusion proteins of the invention can find particular use in the treatment of diabetes for glucose regulation, insulin-resistance disorders, obesity, and can be used as a weight loss treatment.

"PYY" means human peptide YY polypeptide and species and sequence variants thereof having at least a portion of the biological activity of mature PYY. PPY-containing fusion proteins of the invention can find particular use in the treatment of diabetes for glucose regulation, insulin-resistance disorders, and obesity. Analogs of PYY have been prepared, as described in U.S. Pat. Nos. 5,604,203, 5,574,010 and 7,166,575.

"Urocortin" means a human urocortin peptide hormone and sequence variants thereof having at least a portion of the biological activity of mature urocortin. There are three human urocortins: Ucn-1, Ucn-2 and Ucn-3. Further urocortins and analogs have been described in U.S. Pat. No. 6,214,797. BPXTEN proteins comprising urocortin of the invention can also find particular use in treating or preventing conditions associated with stimulating ACTH release, hypertension due to vasodilatory effects, inflammation mediated via other than ACTH elevation, hyperthermia, appetite disorder, congestive heart failure, stress, anxiety, and psoriasis. Urocortin-containing fusion proteins can also be combined with a natriuretic peptide module, amylin family, and exendin family, or a GLP1 family module to provide an enhanced cardiovascular benefit, e.g. treating CHF, as by providing a beneficial vasodilation effect.

Metabolic Disease and Cardiovascular Proteins

Metabolic and cardiovascular diseases represent a substantial health care burden in most developed nations, with cardiovascular diseases remaining the number one cause of death and disability in the United States and most European countries. Metabolic diseases and disorders include a large variety of conditions affecting the organs, tissues, and circulatory system of the body Dyslipidemia is a frequent occurrence among diabetics and human or animals with cardiovascular disease; typically characterized by parameters such as elevated plasma triglycerides, low HDL (high density lipoprotein) cholesterol, normal to elevated levels of LDL (low density lipoprotein) cholesterol and increased levels of small dense, LDL particles in the blood. Dyslipidemia and hypertension is a main contributor to an increased incidence of coronary events, renal disease, and deaths among human or animals with metabolic diseases like diabetes and cardiovascular disease.

Cardiovascular disease can be manifest by many disorders, symptoms and changes in clinical parameters involving the heart, vasculature and organ systems throughout the body, including aneurysms, angina, atherosclerosis, cerebrovascular accident (Stroke), cerebrovascular disease, congestive heart failure, coronary artery disease, myocardial infarction, reduced cardiac output and peripheral vascular disease, hypertension, hypotension, blood markers (e.g., C-reactive protein, BNP, and enzymes such as CPK, LDH, SGPT, SGOT), amongst others.

Most metabolic processes and many cardiovascular parameters are regulated by multiple peptides and hormones ("metabolic proteins"), and many such peptides and hormones, as well as analogues thereof, have found utility in the treatment of such diseases and disorders. However, the use of therapeutic peptides and/or hormones, even when augmented by the use of small molecule drugs, has met with limited success in the management of such diseases and disorders. In particular, dose optimization is important for drugs and biologics used in the treatment of metabolic diseases, especially those with a narrow therapeutic window. Hormones in general, and peptides involved in glucose homeostasis often have a narrow therapeutic window. The narrow therapeutic window, coupled with the fact that such hormones and peptides typically have a short half-life which necessitates frequent dosing in order to achieve clinical benefit, results in difficulties in the management of such patients. Therefore, there remains a need for therapeutics with increased efficacy and safety in the treatment of metabolic diseases.

Thus, one aspect of the present invention is the incorporation of biologically active metabolic proteins and involved in or used in the treatment of metabolic and cardiovascular diseases and disorders into BPXTEN fusion proteins to create compositions with utility in the treatment of such disorders, disease and related conditions. The metabolic proteins can include any protein of biologic, therapeutic, or prophylactic interest or function that is useful for preventing, treating, mediating, or ameliorating a metabolic or cardiovascular disease, disorder or condition. Table 4d provides a non-limiting list of such sequences of metabolic BPs that are encompassed by the BPXTEN fusion proteins of the invention. Metabolic proteins of the inventive BPXTEN compositions can be a protein that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a protein sequence selected from Table 4d.

TABLE 4d

Biologically Active Proteins for Metabolic Disorders and Cardiology

| Name of Protein (Synonym) | Sequence | SEQ ID NO. |
|---|---|---|
| Anti-CD3 | See U.S. Pat. Nos. 5,885,573 and 6,491,916 | |
| IL-1ra, human full length | MEICRGLRSHLITLLLFLFHSETICRPSGRKSSKMQAFRIWDVNQKTFYLRN NQLVAGYLQGPNVNLEEKIDVVPIEPHALFLGIHGGKMCLSCVKSGDETRL QLEAVNITDLSENRKQDKRFAFIRSDSGPTTSFESAACPGWFLCTAMEADQ PVSLTNMPDEGVMVTKFYFQEDE | 1723 |
| IL-1ra, Dog | METCRCPLSYLISFLLFLPHSETACRLGKRPCRMQAFRIWDVNQKTFYLRN NQLVAGYLQGSNTKLEEKLDVVPVEPHAVFLGIHGGKLCLACVKSGDETR LQLEAVNITDLSKNKDQDKRFTFILSDSGPTTSFESAACPGWFLCTALEADR PVSLTNRPEEAMMVTKFYFQKE | 1724 |
| IL-1ra, Rabbit | MRPSRSTRRHLISLLLFLFHSETACRPSGKRPCRMQAFRIWDVNQKTFYLR NNQLVAGYLQGPNAKLEERIDVVPLEPQLLFLGIQRGKLCLSCVKSGDKM KLHLEAVNITDLGKNKEQDKRFTFIRSNSGPTTTFESASCPGWFLCTALEAD QPVSLTNTPDDSIVVTKFYFQED | 1725 |
| IL-1ra, Rat | MEICRGPYSHLISLLLILLFRSESAGHIPAGKRPCKMQAFRIWDTNQKTFYL RNNQLIAGYLQGPNTKLEEKIDMVPIDFRNVFLGIHGGKLCLSCVKSGDDT KLQLEEVNITDLNKNKEEDKRFTFIRSETGPTTSFESLACPGWFLCTTLEAD HPVSLTNTPKEPCTVTKFYFQED | 1726 |
| IL-1ra, Mouse | MEICWGPYSHLISLLLILLFHSEAACRPSGKRPCKMQAFRIWDTNQKTFYLR NNQLIAGYLQGPNIKLEEKIDMVPIDLHSVFLGIHGGKLCLSCAKSGDDIKL QLEEVNITDLSKNKEEDKRFTFIRSEKGPTTSFESAACPGWFLCTTLEADRP VSLTNTPEEPLIVTKFYFQEDQ | 1727 |
| Anakinra | MRPSGRKSSKMQAFRIWDVNQKTFYLRNNQLVAGYLQGPNVNLEEKIDV VPIEPHALFLGIHGGKMCLSCVKSGDETRLQLEAVNITDLSENRKQDKRFA FIRSDSGPTTSFESAACPGWFLCTAMEADQPVSLTNMPDEGVMVTKFYFQE DE | 1728 |
| α-natriuretic peptide (ANP) | SLRRSSCFGGRMDRIGAQSGLGCNSFRY | 1729 |
| β-natriuretic peptide, human (BNP human) | SPKMVQGSGGFGRKMDRISSSSGLGCKVLRRH | 1730 |
| Brain natriuretic peptide, Rat; (BNP Rat) | NSKMAHSSSCFGQKIDRIGAVSRLGCDGLRLF | 1731 |
| C-type natriuretic peptide (CNP, porcine) | GLSKGCFGLKLDRIGSMSGLGC | 1732 |
| Fibroblast growth factor 2 (FGF-2) | PALPEDGGSGAFPPGHFKDPKRLYCKNGGFFLRIHPDGRVDGVREKSDPHI KLQLQAEERGVVSIKGVCANRYLAMKEDGRLLASKCVTDECFFFERLESN NYNTYRS RKYTSWYVAL KRTGQYKLGS KTGPGQKAIL FLPMSAKS | 1733 |

TABLE 4d-continued

Biologically Active Proteins for Metabolic Disorders and Cardiology

| Name of Protein (Synonym) | Sequence | SEQ ID NO. |
|---|---|---|
| TNF receptor (TNFR) | LPAQVAFTPYAPEPGSTCRLREYYDQTAQMCCSKCSPGQHAKVFCTKTSD TVCDSCEDSTYTQLWNWVPECLSCGSRCSSDQVETQACTREQNRICTCRPG WYCALSKQEGCRLCAPLRKCRPGFGVARPGTETSDVVCKPCAPGTFSNTTS STDICRPHQICNVVAIPGNASMDAVCTSTSPTRSMAPGAVHLPQPVSTRSQH TQPTPEPSTAPSTSFLLPMGPSPPAEGSTGD | 1734 |

"Anti-CD3" means the monoclonal antibody against the T cell surface protein CD3, species and sequence variants, and fragments thereof, including OKT3 (also called muromonab) and humanized anti-CD3 monoclonal antibody (hOKT31(Ala-Ala))(Herold et al., 2002, New England Journal of Medicine 346:1692-1698) Anti-CD3-containing fusion proteins of the invention can find particular use to slow new-onset Type 1 diabetes, including use of the anti-CD3 as a therapeutic effector as well as a targeting moiety for a second therapeutic BP in the BPXTEN composition. The sequences for the variable region and the creation of anti-CD3 have been described in U.S. Pat. Nos. 5,885,573 and 6,491,916.

"IL-1ra" means the human IL-1 receptor antagonist protein and species and sequence variants thereof, including the sequence variant anakinra (Kineret®), having at least a portion of the biological activity of mature IL-1ra Anakinra is a nonglycosylated, recombinant human IL-1ra and differs from endogenous human IL-1ra by the addition of an N-terminal methionine. A commercialized version of anakinra is marketed as Kineret®. It binds with the same avidity to IL-1 receptor as native IL-1ra and IL-1b, but does not result in receptor activation (signal transduction), an effect attributed to the presence of only one receptor binding motif on IL-1ra versus two such motifs on IL-1α and IL-1β. Anakinra has 153 amino acids and 17.3 kD in size, and has a reported half-life of approximately 4-6 hours.

Increased IL-1 production has been reported in patients with various microbial infectious diseases and a variety of other diseases. IL-1ra-containing fusion proteins of the invention can find particular use in the treatment of any of the foregoing diseases and disorders. IL-1ra has been cloned, as described in U.S. Pat. Nos. 5,075,222 and 6,858,409.

"Natriuretic peptides" means atrial natriuretic peptide (ANP), brain natriuretic peptide (BNP or B-type natriuretic peptide) and C-type natriuretic peptide (CNP); both human and non-human species and sequence variants thereof having at least a portion of the biological activity of the mature counterpart natriuretic peptides. Sequences of useful forms of natriuretic peptides are disclosed in U.S. Patent Publication 20010027181. Examples of ANPs include human ANP (Kangawa et al., 1984, BBRC 118:131) or that from various species, including pig and rat ANP (Kangawa et al., 1984, BBRC 121:585). Sequence analysis revealed that preproBNP consists of 134 residues and is cleaved to a 108-amino acid ProBNP. Cleavage of a 32-amino acid sequence from the C-terminal end of ProBNP results in human BNP (77-108), which is the circulating, physiologically active form. The 32-amino acid human BNP involves the formation of a disulfide bond (Sudoh et al., 1989, BBRC 159:1420) and U.S. Pat. Nos. 5,114,923, 5,674,710, 5,674,710, and 5,948,761. BPXTEN-containing one or more natriuretic functions can be useful in treating hypertension, diuresis inducement, natriuresis inducement, vascular conduct dilatation or relaxation, natriuretic peptide receptors (such as NPR-A) binding, aldostrerone secretion suppression from the adrenal gland, treatment of cardiovascular diseases and disorders, reducing, stopping or reversing cardiac remodeling after a cardiac event or as a result of congestive heart failure, treatment of renal diseases and disorders; treatment or prevention of ischemic stroke, and treatment of asthma.

"Heparin-binding growth factor 2" or "FGF-2" means the human FGF-2 protein, and species and sequence variants thereof having at least a portion of the biological activity of the mature counterpart. FGF-2 has been cloned, as described in Burgess, W. H. and Maciag, T., Ann. Rev. Biochem., 58:575-606 (1989); Coulier, F., et al., 1994, Prog. Growth Factor Res. 5:1; and the PCT publication WO 87/01728.

"TNF receptor" means the human receptor for TNF, and species and sequence variants thereof having at least a portion of the biological receptor activity of mature TNFR. The x-ray crystal structure of the complex formed by the extracellular domain of the human p55 TNF receptor and TNFβ has been determined (Banner et al., 1993 Cell 73:431, incorporated herein by reference).

Coagulation Factors

In hemophilia, the clotting of blood is disturbed by a lack of certain plasma blood clotting factors. Human factor IX (FIX) is a zymogen of a serine protease that is an important component of the intrinsic pathway of the blood coagulation cascade. Factor VIIa (FVIIa) proteins have found utility for the treatment of bleeding episodes in hemophilia A or B patients with inhibitors to FVIII or FIX and in patients with acquired hemophilia, as well as prevention of bleeding in surgical interventions or invasive procedures in hemophilia A or B patients with inhibitors to FVIII or FIX. Thus, there remains a need for factor IX and factor VIIa compositions with extended half-life and retention of activity when administered as part of a preventive and/or therapeutic regimen for hemophilia B, as well as formulations that reduce side effects and can be administered by both intravenous and subcutaneous routes.

The coagulation factors for inclusion in the BPXTEN of the invention can include proteins of biologic, therapeutic, or prophylactic interest or function that are useful for preventing, treating, mediating, or ameliorating blood coagulation disorders, diseases, or deficiencies. Suitable coagulation proteins include biologically active polypeptides that are involved in the coagulation cascade as substrates, enzymes or co-factors.

Table 4e provides a non-limiting list of sequences of coagulation factors that are encompassed by the BPXTEN fusion proteins of the invention. Coagulation factors for inclusion in the BPXTEN of the invention can be a protein that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a protein sequence selected from Table 4e.

TABLE 4e

| Coagulation Factor Polypeptide Sequences | | |
|---|---|---|
| BPXTEN Name | SEQ ID NO: | Amino Acid Sequence |
| FIX precursor | 1735 | MQRVNMIMAESPGLITICLLGYLLSAECTVFLDHENANKILNRPKRYNSGKLEEFV QGNLERECMEEKCSFEEAREVFENTERTTEFWKQYVDGDQCESNPCLNGGSCKD DINSYECWCPFGFEGKNCELDVTCNIKNGRCEQFCKNSADNKVVCSCTEGYRLAE NQKSCEPAVPFPCGRVSVSQTSKLTRAETVFPDVDYVNSTEAETILDNITQSTQSFN DFTRVVGGEDAKPGQFPWQVVLNGKVDAFCGGSIVNEKWIVTAAHCVETGVKIT VVAGEHNIEETEHTEQKRNVIRIIPHHNYNAAINKYNHDIALLELDEPLVLNSYVTPI CIADKEYTNIFLKFGSGYVSGWGRVFHKGRSALVLQYLRVPLVDRATCLRSTKFTI YNNMFCAGFHEGGRDSCQGDSGGPHVTEVEGTSFLTGIISWGEECAMKGKYGIYT KVSRYVNWIKEKTKLT |
| FIX *Homo* sapiens | 1736 | YNSGKLEEFVQGNLERECMEEKCSFEEAREVFENTERTTEFWKQYVDGDQCESNP CLNGGSCKDDINSYECWCPFGFEGKNCELDVTCNIKNGRCEQFCKNSADNKVVCS CTEGYRLAENQKSCEPAVPFPCGRVSVSQTSKLTRAETVFPDVDYVNSTEAETILD NITQSTQSFNDFTRVVGGEDAKPGQFPWQVVLNGKVDAFCGGSIVNEKWIVTAAH CVETGVKITVVAGEHNIEETEHTEQKRNVIRIIPHHNYNAAINKYNHDIALLELDEP LVLNSYVTPICIADKEYTNIFLKFGSGYVSGWGRVFHKGRSALVLQYLRVPLVDRA TCLRSTKFTIYNNMFCAGFHEGGRDSCQGDSGGPHVTEVEGTSFLTGIISWGEECA MKGKYGIYTKVSRYVNWIKEKTKLT |
| Sequence 4 from Patent US 20080214462 | 1737 | MQRVNMIMAESPGLITICLLGYLLSAECTVFLDHENANKILNRPKRYNSGKLEEFV QGNLERECMEEKCSFEEAREVFENTERTTEFWKQYVDGDQCESNPCLNGGSCKD DINSYECWCPFGFEGKNCELDVTCNIKNGRCEQFCKNSADNKVVCSCTEGYRLAE NQKSCEPAVPFPCGRVSVSQTSKLTRAEAVFPDVDYVNSTEAETILDNITQSTQSFN DFTRVVGGEDAKPGQFPWQVVLNGKVDAFCGGSIVNEKWIVTAAHCVETGVKIT VVAGEHNIEETEHTEQKRNVIRIIPHHNFNAAINTYNHDIALLELDEPLVNSYVTPIC IADKEYTNIFLKFGSGYVSGWGRVFHKGRSALVLQYLRVPLVDRATCLRSTKFTIY NNMFCAGFHEGGRDSCQGDSGGPHVTEVEGTSFLTGIISWGEECAMKGKYGIYTK VSRYVNWIKEKTKLT |
| Sequence 6 from Patent US 20080214462 | 1738 | MQRVNMIMAESPGLITICLLGYLLSAECTVFLDHENANKILNRPKRYNSGKLEEFV QGNLERECMEEKCSFEEAREVFENTERTTEFWKQYVDGDQCESNPCLNGGSCKD DINSYECWCPFGFEGKNCELDVTCNIKNGRCEQFCKNSADNKVVCSCTEGYRLAE NQKSCEPAVPFPCGRVSVSQTSKLTRAEAVFPDVDYVNSTEAETILDNITQSTQSFN DFTRVVGGEDAKPGQFPWQVVLNGKVDAFCGGSIVNEKWIVTAAHCVETGVKIT VVAGEHNIEETEHTEQKRNVIRIIPHHNFNAAINTYNHDIALLELDEPLVNSYVTPIC IADKEYTNIFLKFGSGYVSGWGRVFHKGRSALVLQYLRVPLVDRATCLRSTKFTIF NNMFCAGFHEGGRDSCQGDSGGPHVTEVEGTSFLTGIISWGEECAMKGKYGIYTK VSRYVNWIKEKTKLT |
| Sequence 8 from Patent US 20080214462 | 1739 | MQRVNMIMAESPGLITICLLGYLLSAECTVFLDHENANKILNRPKRYNSGKLEEFV QGNLERECMEEKCSFEEAREVFENTERTTEFWKQYVDGDQCESNPCLNGGSCKD DINSYECWCPFGFEGKNCELDVTCNIKNGRCEQFCKNSADNKVVCSCTEG YRLAENQKSCEPAVPFPCGRVSVSQTSKLTRAEAVFPDVDYVNSTEAETILDNITQS TQSFNDFTRVVGGEDAKPGQFPWQVVLNGKVDAFCGGSIVNEKWIVTAAHCVET GVKITVVAGEHNIEETEHTEQKRNVIRIIPHHNFNAAINTYNHDIALLELDEPLVLNS YVTPICIADKEYTNIFLKFGSGYVSGWGRVFHKGRSALVLQYLRVPLVDATCLRST KFTIFNNMFCAGFHEGGRDSCQGDSGGPHVTEVEGTSFLTGIVSWGEGCAMKGKY GIYTKVSRYVNWIKEKTKLT |
| Sequence 2 from Patent US 7125841 | 1740 | MQRVNMIMAESPSLITICLLGYLLSAECTVFLDHENANKILNRPKRYNSGKLEEFV QGNLERECMEEKCSFEEPREVFENTEKITEFWKQYVDGDQCESNPCLNGGSCKDDI NSYECWCPFGFEGKNCELDVTCNIKNGRCEQFCKNSADNKVVCSCTEGYRLAEN QKSCEPAVPFPCGRVSVSQTSKLTRAEAVFPDVDYVNPTEAETILDNITQGTQSFND FTRVVGGEDAKPGQFPWQVVLNGKVDAFCGGSIVNEKWIVTAAHCVETGVKITV VAGEHNIEETEHTEQKRNVIRAIIPHHNYNAAINKYNHDIALLELDEPLVLNSYVTPI CIADKEYTNIFLKFGSGYVSGWARVFHKGRSALVLQYLRVPLVDRATCLRSTKFTI YNNMFCAGFHEGGRDSCQGDSGGPHVTEVEGTSFLTGIISWGEECAMKGKYGIYT KVSRYVNWIKEKTKLT |
| Sequence 1 from Patent US 20080167219 | 1741 | YNSGKLEEFVQGNLERECMEEKCSFEEAREVFENTERTTEFWKQYVDGDQCESNP CLNGGSCKDDINSYECWCPFGFEGKNCELDATCNIKNGRCEQFCKNSADNKVVCS CTEGYRLAENQKSCEPAVPFPCGRVSVSQTSKLTRAETVFPDVDYVNSTEAETILD NITQSTQSFNDFTRVVGGEDAKPGQFPWQVVLNGKVDAFCGGSIVNEKWIVTAAH CVETGVKITVVAGEHNIEETEHTEQKRNVIRIIPHHNYNAAINKYNHDIALLELDEP LVLNSYVTPICIADKEYTNIFLKFGSGYVSGWGRVFHKGRSALVLQYLRVPLVDRA TCLRSTKFTIYNNMFCAGFHEGGRDSCQGDSGGPHVTEVEGTSFLTGIISWGEECA MKGKYGIYTKVSRYVNWIKEKTKLT |

TABLE 4e-continued

Coagulation Factor Polypeptide Sequences

| BPXTEN Name | SEQ ID NO: | Amino Acid Sequence |
|---|---|---|
| Sequence 2 from Patent US 20080167219 | 1742 | YNSGKLEEFVQGNLERECMEEKCSFEEAREVFENTERTTEFWKQYVDGDQCESNP CLNGGSCKDDINSYECWCPFGFEGKNCELDVTCNIKNGRCEQFCKNSADNKVVCS CTEGYRLAENQKSCEPAVPFPCGRVSVSQTSKLTRAETVFPDVDYVNSTEAETILD NITQSTQSFNDFTRVVGGEDAKPGQFPWQVVLNGKVDAFCGGSIVNEKWIVTAAH CVETGVKITVVAGEHNIEETEHTEQKRNVIRIIPHHNYNAAINKYNHDIALLELDAP LVLNSYVTPICIADKEYTNIFLKFGSGYVSGWGRVFHKGRSALVLQYLRVPLVDRA TCLRSTKFTIYNNMFCAGFHEGGRDSCQGDSGGPHVTEVEGTSFLTGIISWGEECA MKGKYGIYTKVSRYVNWIKEKTKLT |
| Sequence 3 from Patent US 20080167219 | 1743 | YNSGKLEEFVQGNLERECMEEKCSFEEAREVFENTERTTEFWKQYVDGDQCESNP CLNGGSCKDDINSYECWCPFGFEGKNCELDATCNIKNGRCEQFCKNSADNKVVCS CTEGYRLAENQKSCEPAVPFPCGRVSVSQTSKLTRAETVFPDVDYVNSTEAETILD NITQSTQSFNDFTRVVGGEDAKPGQFPWQVVLNGKVDAFCGGSIVNEKWIVTAAH CVETGVKITVVAGEHNIEETEHTEQKRNVIRIIPHHNYNAAINKYNHDIALLELDAP LVLNSYVTPICIADKEYTNIFLKFGSGYVSGWGRVFHKGRSALVLQYLRVPLVDRA TCLRSTKFTIYNNMFCAGFHEGGRDSCQGDSGGPHVTEVEGTSFLTGIISWGEECA MKGKYGIYTKVSRYVNWIKEKTKLT |
| Sequence 4 from Patent US 20080167219 | 1744 | YNSGKLEEFVQGNLERECMEEKCSFEEAREVFENTERTTEFWKQYVDGDQCESNP CLNGGSCKDDINSYECWCPFGFEGKNCELDATCNIKNGRCEQFCKNSADNKVVCS CTEGYRLAENQKSCEPAVPFPCGRVSVSQTSKLTRAETVFPDVDYVNSTEAETILD NITQSTQSFNDFTRVVGGEDAKPGQFPWQVVLNGKVDAFCGGSIVNEKWIVTAAH CVETGVKITVVAGEHNIEETEHTEQKRNVIRIIPHHNYNAAINKYNHDIALLELDEP LVLNSYVTPICIADKEYTNIFLKFGSGYVSGWGRVFHKGRSALVLQYLRVPLVDRA TCLASTKFTIYNNMFCAGFHEGGRDSCQGDSGGPHVTEVEGTSFLTGIISWGEECA MKGKYGIYTKVSRYVNWIKEKTKLT |
| Sequence 5 from Patent US 20080167219 | 1745 | YNSGKLEEFVQGNLERECMEEKCSFEEAREVFENTERTTEFWKQYVDGDQCESNP CLNGGSCKDDINSYECWCPFGFEGKNCELDVTCNIKNGRCEQFCKNSADNKVVCS CTEGYRLAENQKSCEPAVPFPCGRVSVSQTSKLTRAETVFPDVDYVNSTEAETILD NITQSTQSFNDFTRVVGGEDAKPGQFPWQVVLNGKVDAFCGGSIVNEKWIVTAAH CVETGVKITVVAGEHNIEETEHTEQKRNVIRIIPHHNYNAAINKYNHDIALLELDAP LVLNSYVTPICIADKEYTNIFLKFGSGYVSGWGRVFHKGRSALVLQYLRVPLVDRA TCLASTKFTIYNNMFCAGFHEGGRDSCQGDSGGPHVTEVEGTSFLTGIISWGEECA MKGKYGIYTKVSRYVNWIKEKTKLT |
| Sequence 6 from Patent US 20080167219 | 1746 | YNSGKLEEFVQGNLERECMEEKCSFEEAREVFENTERTTEFWKQYVDGDQCESNP CLNGGSCKDDINSYECWCPFGFEGKNCELDATCNIKNGRCEQFCKNSADNKVVCS CTEGYRLAENQKSCEPAVPFPCGRVSVSQTSKLTRAETVFPDVDYVNSTEAETILD NITQSTQSFNDFTRVVGGEDAKPGQFPWQVVLNGKVDAFCGGSIVNEKWIVTAAH CVETGVKITVVAGEHNIEETEHTEQKRNVIRIIPHHNYNAAINKYNHDIALLELDAP LVLNSYVTPICIADKEYTNIFLKFGSGYVSGWGRVFHKGRSALVLQYLRVPLVDRA TCLASTKFTIYNNMFCAGFHEGGRDSCQGDSGGPHVTEVEGTSFLTGIISWGEECA MKGKYGIYTKVSRYVNWIKEKTKLT |
| Factor VII/VIIa | 1747 | ANAFLEELRPGSLERECKEEQCSFEEAREIFKDAERTKLFWISYSDGDQCASSPCQN GGSCKDQLQSYICFCLPAFEGRNCETHKDDQLICVNENGGCEQYCSDHTGTKRSC RCHEGYSLLADGVSCTPTVEYPCGKIPILEKRNASKPQGRIVGGKVCPKGECPWQV LLLVNGAQLCGGTLINTIWVVSAAHCFDKIKNWRNLIAVLGEHDLSEHDGDEQSR RVAQVIIPSTYVPGTTNHDIALLRLHQPVVLTDHVVPLCLPERTFSERTLAFVRFSL VSGWGQLLDRGATALELMVLNVPRLMTQDCLQQSRKVGDSPNITEYMFCAGYSD GSKDSCKGDSGGPHATHYRGTWYLTGIVSWGQGCATVGHFGVYTRVSQYIEWLQ KLMRSEPRPGVLLRAPFP |

"Factor IX" ("FIX") includes the human Factor IX protein and species and sequence variants thereof having at least a portion of the biological receptor activity of mature Factor IX. In some embodiments, the FIX peptide is a structural analog or peptide mimetic of any of the FIX peptides described herein, including the sequences of Table 4e. In some embodiments, the FIX peptide is a structural analog or peptide mimetic of any of the FIX peptides described herein, including the sequences of Table 4e. In one specific example of the present invention, the FIX is human FIX. In another embodiment, the FIX is a polypeptide sequence from Table 4e. Mature Factor IX is a single chain protein of 415 amino acid residues that contains approximately 17% carbohydrate by weight (Schmidt 2003, Trends Cardiovasc Med, 13:39).

In some cases, the coagulation factor is Factor IX, a sequence variant of Factor IX, or a Factor IX moiety, such as the exemplary sequences of Table 4e, as well as any protein or polypeptide substantially homologous thereto whose biological properties result in the activity of Factor IX.

"Factor VII" (FVII) means the human protein, and species and sequence variants thereof having at least a portion of the biological activity of activated Factor VII. Factor VII and recombinant human FVIIa has been introduced for use in uncontrollable bleeding in hemophilia patients (with Factor VIII or IX deficiency) who have developed inhibitors against replacement coagulation factor. Recombinant human factor VIIa has utility in treatment of uncontrollable bleeding in hemophilia patients (with Factor VIII or IX deficiency), including those who have developed inhibitors against replacement coagulation factor. In some embodiments, the FVII peptide is the activated form (FVIIa), a structural analog or peptide mimetic of any of the FVII peptides described herein, including sequences of Table 4e. Factor VII and VIIa have been cloned, as described in U.S. Pat. No. 6,806,063 and US Patent Application No. 20080261886.

Growth Hormone Proteins

"Growth Hormone" or "GH" means the human growth hormone protein and species and sequence variants thereof, and includes, but is not limited to, the 191 single-chain amino acid human sequence of GH. The invention contemplates inclusion in the BPXTEN of any GH homologous sequences, sequence fragments that are natural, such as from primates, mammals (including domestic animals), and non-natural sequence variants which retain at least a portion of the biologic activity or biological function of GH and/or that are useful for preventing, treating, mediating, or ameliorating a GH-related disease, deficiency, disorder or condition. Non-mammalian GH sequences are well-described in the literature. For example, a sequence alignment of fish GHs can be found in *Genetics and Molecular Biology* 2003 26 p. 295-300. In addition, native sequences homologous to human GH can be found by standard homology searching techniques, such as NCBI BLAST.

In one embodiment, the GH incorporated into the human or animal compositions can be a recombinant polypeptide with a sequence corresponding to a protein found in nature. In another embodiment, the GH can be a sequence variant, fragment, homolog, or a mimetics of a natural sequence that retains at least a portion of the biological activity of the native GH. Table 4f provides a nonlimiting list of sequences of GHs from a wide variety of mammalian species that are encompassed by the BPXTEN fusion proteins of the invention. Any of these GH sequences or homologous derivatives constructed by shuffling individual mutations between species or families can be useful for the fusion proteins of this invention. GH that can be incorporated into a BPXTEN fusion protein can include a protein that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a protein selected from Table 4f.

TABLE 4f

Growth Hormone Amino Acid Sequences From Animal Species

| Species GH | Amino Acid Sequence | SEQ ID NO. |
|---|---|---|
| Man | FPTIPLSRLFDNAMLRAHRLHQLAFDTYQEFEEAYIPKEQKYSFLQNPQTSLCF<br>SESIPTPSNREETQQKSNLELLRISLLLIQSWLEPVQFLRSVFANSLVYGASDSN<br>VYDLLKDLEEGIQTLMGRLEDGSPRTGQIFKQTYSKFDTNSHNDDALLKNYG<br>LLYCFRKDMDKVETFLRIVQCRSVEGSCGF | 1750 |
| Pig | FPAMPLSSLFANAVLRAQHLHQLAADTYKEFERAYIPEGQRYSIQNAQAAFC<br>FSETIPAPTGKDEAQQRSDVELLRFSLLLIQSWLGPVQFLSRVFTNSLVFGTSD<br>RVYEKLKDLEEGIQALMRELEDGSPRAGQILKQTYDKFDTNLRSDDALLKNY<br>GLLSCFKKDLHKAETYLRVMKCRRFVESSCAF | 1751 |
| Alpaca | FPAMPLSSLFANAVLRAQHLHQLAADTYKEFERTYIPEGQRYSIQNAQAAFCF<br>SETIPAPTGKDEAQQRSDVELLRFSLLLIQSWLGPVQFLSRVFTNSLVFGTSDR<br>VYEKLKDLEEGIQALMRELEDGSPRAGQILRQTYDKFDTNLRSDDALLKNYG<br>LLSCFKKDLHKAETYLRVMKCRRFVESSCAF | 1752 |
| Camel | FPAMPLSSLFANAVLRAQHLHQLAADTYKEFERTYIPEGQRYSIQNAQAAFCF<br>SETIPAPTGKDEAQQRSDVELLRFSLLLIQSWLGPVQFLSRVFTNSLVFGTSDR<br>VYEKLKDLEEGIQALMRELEDGSPRAGQILRQTYDKFDTNLRSDDALLKNYG<br>LLSCFKKDLHKAETYLRVMKCRRFVESSCAF | 1753 |
| Horse | FPAMPLSSLFANAVLRAQHLHQLAADTYKEFERAYIPEGQRYSIQNAQAAFC<br>FSETIPAPTGKDEAQQRSDMELLRFSLLLIQSWLGPVQLLSRVFTNSLVFGTSD<br>RVYEKLRDLEEGIQALMRELEDGSPRAGQILKQTYDKFDTNLRSDDALLKNY<br>GLLSCFKKDLHKAETYLRVMKCRRFVESSCAF | 1754 |
| Elephant | FPAMPLSSLFANAVLRAQHLHQLAADTYKEFERAYIPEGQRYSIQNAQAAFC<br>FSETIPAPTGKDEAQQRSDVELLRFSLLLIQSWLGPVQFLSRVFTNSLVFGTSD<br>RVYEKLKDLEEGIQALMRELEDGSPRPGQVLKQTYDKFDTNMRSDDALLKN<br>YGLLSCFKKDLHKAETYLRVMKCRRFVESSCAF | 1755 |
| Red fox | FPAMPLSSLFANAVLRAQHLHQLAADTYKEFERAYIPEGQRYSIQNAQAAFC<br>FSETIPAPTGKDEAQQRSDVELLRFSLVLIQSWLGPLQFLSRVFTNSLVFGTSD<br>RVYEKLKDLEEGIQALMRELEDGSPRAGQILKQTYDKFDTNLRSDDALLKNY<br>GLLSCFKKDLHKAETYLRVMKCRRFVESSCAF | 1756 |
| Dog | FPAMPLSSLFANAVLRAQHLHQLAADTYKEFERAYIPEGQRYSIQNAQAAFC<br>FSETIPAPTGKDEAQQRSDVELLRFSLLLIQSWLGPVQFLSRVFTNSLVFGTSD<br>RVYEKLKDLEEGIQALMRELEDGSPRAGQILKQTYDKFDTNLRSDDALLKNY<br>GLLSCFKKDLHKAETYLRVMKCRRFVESSCAF | 1757 |
| Cat | FPAMPLSSLFANAVLRAQHLHQLAADTYKEFERAYIPEGQRYSIQNAQAAFC<br>FSETIPAPTGKDEAQQRSDVELLRFSLLLIQSWLGPVQFLSRVFTNSLVFGTSD<br>RVYEKLKDLEEGIQALMRELEDGSPRGGQILKQTYDKFDTNLRSDDALLKNY<br>GLLSCFKKDLHKAETYLRVMKCRRFVESSCAF | 1758 |

TABLE 4f-continued

| Growth Hormone Amino Acid Sequences From Animal Species | | |
|---|---|---|
| Species GH | Amino Acid Sequence | SEQ ID NO. |
| American mink | FPAMPLSSLFANAVLRAQHLHQLAADTYKDFERAYIPEGQRYSIQNAQAAFC FSETIPAPTGKDEAQQRSDMELLRFSLLLIQSWLGPVQFLSRVFTNSLVFGTSD RVYEKLKDLEEGIQALMRELEDGSPRAGPILKQTYDKFDTNLRSDDALLKNY GLLSCFKKDLHKAETYLRVMKCRRFVESSCAF | 1759 |
| Finback whale | FPAMPLSSLFANAVLRAQHLHQLAADTYKEFERAYIPEGQRYSIQNAQAAFC FSETIPAPTGKDEAQQRSDVELLRFSLLLIQSWLGPVQFLSRVFTNSLVFGTSD RVYEKLKDLEEGIQALMRELEDGSPRAGQILKQTYDKFDTNMRSDDALLKN YGLLSCFKKDLHKAETYLRVMKCRRFVESSCAF | 1760 |
| Dolphin | FPAMPLSSLFANAVLRAQHLHQLAADTYKEFERAYIPEGQRYSIQNTQAAFCF SETIPAPTGKDEAQQRSDVELLRFSLLLIQSWLGPVQFLSRVFTNSLVFGTSDR VYEKLKDLEEGIQALMRELEDGSPRAGQILKQTYDKFDTNMRSDDALLKNY GLLSCFKKDLHKAETYLRVMKCRRFVESSCAF | 1761 |
| Hippo | FPAMPLSSLFANAVLRAQHLHQLAADTYKEFERAYIPEGQRYSIQNTQAAFCF SETIPAPTGKDEAQQRSDVELLRFSLLLIQSWLGPVQFLSRVFTNSLVFGTSDR VYEKLKDLEEGIQALMRELEDGSPRAGQILKQTYDKFDTNMRSDDALLKNY GLLSCFKKDLHKAETYLRVMKCRRFVESSCAF | 1762 |
| Rabbit | FPAMPLSSLFANAVLRAQHLHQLAADTYKEFERAYIPEGQRYSIQNAQAAFC FSETIPAPTGKDEAQQRSDMELLRFSLLLIQSWLGPVQFLSRAFTNTLVFGTSD RVYEKLKDLEEGIQALMRELEDGSPRVGQLLKQTYDKFDTNLRGDDALLKN YGLLSCFKKDLHKAETYLRVMKCRRFVESSCVF | 1763 |
| Rat | FPAMPLSSLFANAVLRAQHLHQLAADTYKEFERAYIPEGQRYSIQNAQAAFC FSETIPAPTGKEEAQQRTDMELLRFSLLLIQSWLGPVQFLSRIFTNSLMFGTSD RVYEKLKDLEEGIQALMQELEDGSPRIGQILKQTYDKFDANMRSDDALLKNY GLLSCFKKDLHKAETYLRVMKCRRFAESSCAF | 1764 |
| Mouse | FPAMPLSSLFSNAVLRAQHLHQLAADTYKEFERAYIPEGQRYSIQNAQAAFCF SETIPAPTGKEEAQQRTDMELLRFSLLLIQSWLGPVQFLSRIFTNSLMFGTSDR VYEKLKDLEEGIQALMQELEDGSPRVGQILKQTYDKFDANMRSDDALLKNY GLLSCFKKDLHKAETYLRVMKCRRFVESSCAF | 1765 |
| Hamster | FPAMPLSSLFANAVLRAQHLHQLAADTYKEFERAYIPEGQRYSIQNAQTAFCF SETIPAPTGKEEAQQRSDMELLRFSLLLIQSWLGPVQFLSRIFTNSLMFGTSDR VYEKLKDLEEGIQALMQELEDGSPRVGQILKQTYDKFDTNMRSDDALLKNY GLLSCFKKDLHKAETYLRVMKCRRFVESSCAF | 1766 |
| Mole rat | FPAMPLSNLFANAVLRAQHLHQLAADTYKEFERAYIPEGQRYSIQNAQAAFC FSETIPAPTGKEEAQQRSDMELLRFSLLLIQSWLGPVQFLSRVFTNSLVFGTSD RVFEKLKDLEEGIQALMRELEDGSLRAGQLLKQTYDKFDTNMRSDDALLKN YGLLSCFKKDLHKAETYLRVMKCRRFVESSCAF | 1767 |
| Guinea pig | FPAMPLSSLFGNAVLRAQHLHQLAADTYKEFERTYIPEGQRYSIHNTQTAFCF SETIPAPTDKEEAQQRSDVELLHFSLLLIQSWLGPVQFLSRVFTNSLVFGTSDR VYEKLKDLEEGIQALMRELEDGTPRAGQILKQTYDKFDTNLRSNDALLKNYG LLSCFRKDLHRTETYLRVMKCRRFVESSCAF | 1768 |
| Ox | AFPAMSLSGLFANAVLRAQHLHQLAADTFKEFERTYIPEGQRYSIQNTQVAFC FSETIPAPTGKNEAQQKSDLELLRISLLLIQSWLGPLQFLSRVFTNSLVFGTSDR VYEKLKDLEEGILALMRELEDGTPRAGQILKQTYDKFDTNMRSDDALLKNY GLLSCFRKDLHKTETYLRVMKCRRFGEASCAF | 1769 |
| Sheep/Goat | AFPAMSLSGLFANAVLRAQHLHQLAADTFKEFERTYIPEGQRYSIQNTQVAFC FSETIPAPTGKNEAQQKSDLELLRISLLLIQSWLGPLQFLSRVFTNSLVFGTSDR VYEKLKDLEEGILALMRELEDVTPRAGQILKQTYDKFDTNMRSDDALLKNY GLLSCFRKDLHKTETYLRVMKCRRFGEASCAF | 1770 |
| Red deer | FPAMSLSGLFANAVLRAQHLHQLAADTFKEFERTYIPEGQRYSIQNTQVAFCF SETIPAPTGKNEAQQKSDLELLRISLLLIQSWLGPLQFLSRVFTNSLVFGTSDRV YEKLKDLEEGILALMRELEDGTPRAGQILKQTYDKFDTNMRSDDALLKNYGL LSCFRKDLHKTETYLRVMKCRRFGEASCAF | 1771 |
| Giraffe | AFPAMSLSGLFANAVLRAQHLHQLAADTFKEFERTYIPEGQRYSIQNTQVAFC FSETIPAPTGKNEAQQKSDLELLRISLLLIQSWLGPLQFLSRVFSNSLVFGTSDR VYEKLKDLEEGILALMRELEDGTPRAGQILKQTYDKFDTNMRSDDALLKNY GLLSCFRKDLHKTETYLRVMKCRRFGEASCAF | 1772 |
| Chevrotain-1 | FPAMSLSGLFANAVLRVQHLHQLAADTFKEFERTYIPEGQRYSIQNTQVAFCF SETIPAPTGKNEAQQKSDLELLRISLLLIQSWLGPLQFLSRVFTNSLVFGTSDRV YEKLKDLEEGILALMRELEDGPPRAGQILKQTYDKFDTNMRSDDALLKNYGL LSCFRKDLHKTETYLRVMKCRRFGEASCAF | 1773 |

TABLE 4f-continued

Growth Hormone Amino Acid Sequences From Animal Species

| Species GH | Amino Acid Sequence | SEQ ID NO. |
|---|---|---|
| Slow loris | FPAMPLSSLFANAVLRAQHLHQLAADTYKEFERAYIPEGQRYSIQNAQAAFC FSETIPAPTGKDEAQQRSDMELLRFSLLLIQSWLGPVQLLSRVFTNSLVLGTSD RVYEKLKDLEEGIQALMRELEDGSPRVGQILKQTYDKFDTNLRSDDALLKNY GLLSCFKKDLHKAETYLRVMKCRRFVESSCAF | 1774 |
| Marmoset | FPTIPLSRLLDNAMLRAHRLHQLAFDTYQEFEEAYIPKEQKYSFLQNPQTSLCF SESIPTPASKKETQQKSNLELLRMSLLLIQSWFEPVQFLRSVFANSLLYGVSDS DVYEYLKDLEEGIQTLMGRLEDGSPRTGEIFMQTYRKFDVNSQNNDALLKNY GLLYCFRKDMDKVETFLRIVQCR-SVEGSCGF | 1775 |
| BrTailed Possum | FPAMPLSSLFANAVLRAQHLHQLVADTYKEFERTYIPEAQRHSIQSTQTAFCF SETIPAPTGKDEAQQRSDVELLRFSLLLIQSWLSPVQFLSRVFTNSLVFGTSDR VYEKLRDLEEGIQALMQELEDGSSRGGLVLKTTYDKFDTNLRSDEALLKNYG LLSCFKKDLHKAETYLRVMKCRRFVESSCAF | 1776 |
| Monkey (rhesus) | FPTIPLSRLFDNAMLRAHRLHQLAFDTYQEFEEAYIPKEQKYSFLQNPQTSLCF SESIPTPSNREETQQKSNLELLRISLLLIQSWLEPVQFLRSVFANSLVYGTSYSD VYDLLKDLEEGIQTLMGRLEDGSSRTGQIFKQTYSKFDTNSHNNDALLKNYG LLYCFRKDMDKIETFLRIVQCR-SVEGSCGF | 1777 |

Cytokines

The BP can be a cytokine or one or more cytokines. The cytokines refer to proteins (e.g., chemokines, interferons, lymphokines, interleukins, and tumor necrosis factors) released by cells which can affect cell behavior. Cytokines can be produced by a broad range of cells, including immune cells such as macrophages, B lymphocytes, T lymphocytes and mast cells, as well as endothelial cells, fibroblasts, and various stromal cells. A given cytokine can be produced by more than one type of cell. Cytokines can be involved in producing systemic or local immunomodulatory effects.

Certain cytokines can function as pro-inflammatory cytokines. Pro-inflammatory cytokines refer to cytokines involved in inducing or amplifying an inflammatory reaction. Pro-inflammatory cytokines can work with various cells of the immune system, such as neutrophils and leukocytes, to generate an immune response. Certain cytokines can function as anti-inflammatory cytokines. Anti-inflammatory cytokines refer to cytokines involved in the reduction of an inflammatory reaction. Anti-inflammatory cytokines, in some cases, can regulate a pro-inflammatory cytokine response. Some cytokines can function as both pro- and anti-inflammatory cytokines.

Cytokines encompassed by the inventive compositions can have utility in the treatment in various therapeutic or disease categories, including but not limited to cancer, rheumatoid arthritis, multiple sclerosis, myasthenia gravis, systemic lupus erythematosus, Alzheimer's disease, Schizophrenia, viral infections (e.g., chronic hepatitis C, AIDS), allergic asthma, retinal neurodegenerative processes, metabolic disorder, insulin resistance, and diabetic cardiomyopathy. Cytokines can be especially useful in treating inflammatory conditions and autoimmune conditions.

Examples of cytokines that are regulatable by systems and compositions of the present disclosure include, but are not limited to lymphokines, monokines, and traditional polypeptide hormones except for human growth hormone. Included among the cytokines are parathyroid hormone; thyroxine; insulin; proinsulin; relaxin; prorelaxin; glycoprotein hormones such as follicle stimulating hormone (FSH), thyroid stimulating hormone (TSH), and luteinizing hormone (LH); hepatic growth factor; fibroblast growth factor; prolactin; placental lactogen; tumor necrosis factor-alpha; mullerian-inhibiting substance; mouse gonadotropin-associated peptide; inhibin; activin; vascular endothelial growth factor; integrin; thrombopoietin (TPO); nerve growth factors such as NGF-alpha; platelet-growth factor; transforming growth factors (TGFs) such as TGF-alpha, TGF-beta, TGF-beta1, TGF-beta2, and TGF-beta3; insulin-like growth factor-I and -II; erythropoietin (EPO); Flt-3L; stem cell factor (SCF); osteoinductive factors; interferons (IFNs) such as IFN-α, IFN-γ; colony stimulating factors (CSFs) such as macrophage-CSF (M-CSF); granulocyte-macrophage-CSF (GM-CSF); granulocyte-CSF (G-CSF); macrophage stimulating factor (MSP); interleukins (ILs) such as IL-1, IL-1a, IL-1b, IL-1RA, IL-18, IL-2, IL-3, IL-4, IL-5, IL-6, IL-7, IL-8, IL-9, IL-10, IL-11, IL-12, IL-12b, IL-13, IL-14, IL-15, IL-16, IL-17, IL-20; a tumor necrosis factor such as CD154, LT-beta, TNF-alpha, TNF-beta, 4-1BBL, APRIL, CD70, CD153, CD178, GITRL, LIGHT, OX40L, TALL-1, TRAIL, TWEAK, TRANCE; and other polypeptide factors including LIF, oncostatin M (OSM) and kit ligand (KL). Cytokine receptors refer to the receptor proteins which bind cytokines. Cytokine receptors can be both membrane-bound and soluble.

The target polynucleotide can encode for a cytokine. Non-limiting examples of cytokines include 4-1BBL, activin βA, activin βB, activin βC, activin 13E, artemin (ARTN), BAFF/BLyS/TNFSF138, BMP10, BMP15, BMP2, BMP3, BMP4, BMP5, BMP6, BMP7, BMP8a, BMP8b, bone morphogenetic protein 1 (BMP1), CCL1/TCA3, CCL11, CCL12/MCP-5, CCL13/MCP-4, CCL14, CCL15, CCL16, CCL17/TARC, CCL18, CCL19, CCL2/MCP-1, CCL20, CCL21, CCL22/MDC, CCL23, CCL24, CCL25, CCL26, CCL27, CCL28, CCL3, CCL3L3, CCL4, CCL4L1/LAG-1, CCL5, CCL6, CCL7, CCL8, CCL9, CD153/CD30L/TNFSF8, CD40L/CD154/TNFSF5, CD40LG, CD70, CD70/CD27L/TNFSF7, CLCF1, c-MPL/CD110/TPOR, CNTF, CX3CL1, CXCL1, CXCL10, CXCL11, CXCL12, CXCL13, CXCL14, CXCL15, CXCL16, CXCL17, CXCL2/MIP-2, CXCL3, CXCL4, CXCL5, CXCL6, CXCL7/Ppbp, CXCL9, EDA-A1, FAM19A1, FAM19A2, FAM19A3, FAM19A4, FAM19A5, Fas Ligand/FASLG/CD95L/CD178, GDF10, GDF11, GDF15, GDF2, GDF3, GDF4, GDF5, GDF6, GDF7, GDF8, GDF9, glial cell line-derived neurotrophic factor (GDNF), growth differentiation factor 1 (GDF1), IFNA1, IFNA10, IFNA13, IFNA14, IFNA2, IFNA4, IFNA5/IFNaG, IFNA7, IFNA8, IFNB1, IFNE, IFNG, IFNZ, IFNw/IFNW1, IL11, IL18, IL18BP, ILIA, IL1B, IL1F10, IL1F3/IL1RA, IL1F5, IL1F6, IL1F7, IL1F8, IL1F9, IL1RL2, IL31, IL33, IL6, IL8/CXCL8, inhibin-A, inhibin-B, Leptin, LIF, LTA/TNFB/TNFSF1, LTB/TNFC, neurturin (NRTN), OSM, OX-40L/TNFSF4/CD252, persephin (PSPN), RANKL/OPGL/TNFSF11(CD254), TL1A/TNFSF15, TNFA, TNF-alpha/TNFA, TNFSF10/TRAIL/AP0-2L(CD253), TNFSF12, TNFSF13, TNFSF14/LIGHT/CD258, XCL1, and XCL2. In some embodiments, the target gene encodes for an immune checkpoint inhibitor. Non-limiting examples of such immune checkpoint inhibitors include PD-1, CTLA-4, LAG3, TIM-3, A2AR, B7-H3, B7-H4, BTLA, IDO, KIR, and VISTA. In some embodiments, the target gene encodes for a T cell receptor (TCR) alpha, beta, gamma, and/or delta chain.

In some cases, the cytokine can be a chemokine. The chemokine can be selected from a group including, but not limited to, ARMCX2, BCA-1/CXCL13, CCL11, CCL12/MCP-5, CCL13/MCP-4, CCL15/MIP-5/MIP-1 delta, CCL16/HCC-4/NCC4, CCL17/TARC, CCL18/PARC/MIP-4, CCL19/MIP-3b, CCL2/MCP-1, CCL20/MIP-3 alpha/MIP3A, CCL21/6Ckine, CCL22/MDC, CCL23/MIP 3, CCL24/Eotaxin-2/MPIF-2, CCL25/TECK, CCL26/Eotaxin-3, CCL27/CTACK, CCL28, CCL3/Mipla, CCL4/MIP1B, CCL4L1/LAG-1, CCL5/RANTES, CCL6/C10, CCL8/MCP-2, CCL9, CML5, CXCL1, CXCL10/Crg-2, CXCL12/SDF-1 beta, CXCL14/BRAK, CXCL15/Lungkine, CXCL16/SR-PSOX, CXCL17, CXCL2/MIP-2, CXCL3/GRO gamma, CXCL4/PF4, CXCL5, CXCL6/GCP-2, CXCL9/MIG, FAM19A1, FAM19A2, FAM19A3, FAM19A4/TAFA4, FAM19A5, Fractalkine/CX3CL1, I-309/CCL1/TCA-3, IL-8/CXCL8, MCP-3/CCL7, NAP-2/PPBP/CXCL7, XCL2, and Armo IL10.

Table 4g provides a non-limiting list of such sequences of BPs that are encompassed by the BPXTEN fusion proteins of the invention. Metabolic proteins of the inventive BPXTEN compositions can be a protein that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a protein sequence selected from Table 4g.

TABLE 4g

Cytokines for Conjugation

| Name of Protein (Synonym) | Amino Acid Sequence | SEQ ID NO. |
|---|---|---|
| Anti-CD3 | See U.S. Pat. Nos. 5,885,573 and 6,491,916 | |
| IL-1ra, human full length | MEICRGLRSHLITLLLFLFHSETICRPSGRKSSKMQAFRIWDVNQKTFYLRN NQLVAGYLQGPNVNLEEKIDVVPIEPHALFLGIHGGKMCLSCVKSGDETRL QLEAVNITDLSENRKQDKRFAFIRSDSGPTTSFESAACPGWFLCTAMEADQ PVSLTNMPDEGVMVTKFYFQEDE | 270 |
| IL-1ra, Dog | METCRCPLSYLISFLLFLPHSETACRLGKRPCRMQAFRIWDVNQKTFYLRN NQLVAGYLQGSNTKLEEKLDVVPVEPHAVFLGIHGGKLCLACVKSGDETR LQLEAVNITDLSKNKDQDKRFTFILSDSGPTTSFESAACPGWFLCTALEADR PVSLTNRPEEAMMVTKFYFQKE | 271 |
| IL-1ra, Rabbit | MRPSRSTRRHLISLLLFLFHSETACRPSGKRPCRMQAFRIWDVNQKTFYLR NNQLVAGYLQGPNAKLEERIDVVPLEPQLLFLGIQRGKLCLSCVKSGDKM KLHLEAVNITDLGKNKEQDKRFTFIRSNSGPTTTFESASCPGWFLCTALEAD QPVSLTNTPDDSIVVTKFYFQED | 272 |
| IL-1ra, Rat | MEICRGPYSHLISLLLILLFRSESAGHIPAGKRPCKMQAFRIWDTNQKTFYL RNNQLIAGYLQGPNTKLEEKIDMVPIDFRNVFLGIHGGKLCLSCVKSGDDT KLQLEEVNITDLNKNKEEDKRFTFIRSETGPTTSFESLACPGWFLCTTLEAD HPVSLTNTPKEPCTVTKFYFQED | 273 |
| IL-1ra, Mouse | MEICWGPYSHLISLLLILLFHSEAACRPSGKRPCKMQAFRIWDTNQKTFYLR NNQLIAGYLQGPNIKLEEKIDMVPIDLHSVFLGIHGGKLCLSCAKSGDDIKL QLEEVNITDLSKNKEEDKRFTFIRSEKGPTTSFESAACPGWFLCTTLEADRP VSLTNTPEEPLIVTKFYFQEDQ | 274 |
| Anakinra | MRPSGRKSSKMQAFRIWDVNQKTFYLRNNQLVAGYLQGPNVNLEEKIDV VPIEPHALFLGIHGGKMCLSCVKSGDETRLQLEAVNITDLSENRKQDKRFA FIRSDSGPTTSFESAACPGWFLCTAMEADQPVSLTNMPDEGVMVTKFYFQE DE | 275 |
| IL-10 | MHSSALLCCLVLLTGVRASPGQGTQSENSCTHFPGNLPNMLRDLRDAFSR VKTFFQMKDQLDNLLLKESLLEDFKGYLGCQALSEMIQFYLEEVMPQAEN QDPDIKAHVNSLGENLKTLRLRLRRCHRFLPCENKSKAVEQVKNAFNKLQ EKGIYKAMSEFDIFINYIEAYMTMKIRN | 276 |

"IL-1ra" means the human IL-1 receptor antagonist protein and species and sequence variants thereof, including the sequence variant anakinra (Kineret®), having at least a portion of the biological activity of mature IL-1ra. Human IL-1ra is a mature glycoprotein of 152 amino acid residues. IL-1ra-containing fusion proteins of the invention can find particular use in the treatment of any of the foregoing diseases and disorders. IL-1ra has been cloned, as described in U.S. Pat. Nos. 5,075,222 and 6,858,409.

In some cases, the BP can be IL-10. IL-10 can be an effective anti-inflammatory cytokine that represses the production of the proinflammatory cytokines and chemokines.

IL-10 can be useful for the treatment of autoimmune diseases and inflammatory diseases such as rheumatoid arthritis, multiple sclerosis, myasthenia gravis, systemic lupus erythematosus, Alzheimer's, Schizophrenia, allergic asthma, retinal neurodegenerative processes, and diabetes.

In some cases, IL-10 can be modified to improve stability and decrease prolytic degradation. The modification can be one or more amide bond substitution. In some cases, one or more amide bonds within backbone of IL-10 can be substituted to achieve the abovementioned effects. The one or more amide linkages (—CONH—) in IL-10 can be replaced with a linkage which is an isostere of an amide linkage, such as $—CH_2NH—$, $—CH_2S—$, $—CH_2CH_2—$, —CH═CH— (cis and trans), $—COCH_2—$, $—CH(OH)CH_2—$ or $—CH_2SO—$. Furthermore, the amide linkages in IL-10 can also be replaced by a reduced isostere pseudopeptide bond. See Couder et al. (1993) Int. J. Peptide Protein Res. 41:181-184, which is hereby incorporated by reference in its entirety.

The one or more acidic amino acids, including aspartic acid, glutamic acid, homoglutamic acid, tyrosine, alkyl, aryl, arylalkyl, and heteroaryl sulfonamides of 2,4-diaminopriopionic acid, ornithine or lysine and tetrazole-substituted alkyl amino acids; and side chain amide residues such as asparagine, glutamine, and alkyl or aromatic substituted derivatives of asparagine or glutamine; as well as hydroxyl-containing amino acids, including serine, threonine, homoserine, 2,3-diaminopropionic acid, and alkyl or aromatic substituted derivatives of serine or threonine can be substituted.

The one or more hydrophobic amino acids in IL-10 such as alanine, leucine, isoleucine, valine, norleucine, (S)-2-aminobutyric acid, (S)-cyclohexylalanine or other simple alpha-amino acids can be substituted with amino acids including, but not limited to, an aliphatic side chain from C1-C10 carbons including branched, cyclic and straight chain alkyl, alkenyl or alkynyl substitutions In some cases, the one or more hydrophobic amino acids in IL-10 such as can be substituted substitution of aromatic-substituted hydrophobic amino acids, including phenylalanine, tryptophan, tyrosine, sulfotyrosine, biphenylalanine, 1-naphthylalanine, 2-naphthylalanine, 2-benzothienylalanine, 3-benzothienylalanine, histidine, including amino, alkylamino, dialkylamino, aza, halogenated (fluoro, chloro, bromo, or iodo) or alkoxy (from $C_1$-$C_4$)-substituted forms of the above-listed aromatic amino acids, illustrative examples of which are: 2-, 3- or 4-aminophenylalanine, 2-, 3- or 4-chlorophenylalanine, 2-, 3- or 4-methylphenylalanine, 2-, 3- or 4-methoxyphenylalanine, 5-amino-, 5-chloro-, 5-methyl- or 5-methoxytryptophan, 2'-, 3'-, or 4'-amino-, 2'-, 3'-, or 4'-chloro-, 2, 3, or 4-biphenylalanine, 2'-, 3'-, or 4'-methyl-, 2-, 3- or 4-biphenylalanine, and 2- or 3-pyridylalanine;

The one or more hydrophobic amino acids in IL-10 such as phenylalanine, tryptophan, tyrosine, sulfotyrosine, biphenylalanine, 1-naphthylalanine, 2-naphthylalanine, 2-benzothienylalanine, 3-benzothienylalanine, histidine, including amino, alkylamino, dialkylamino, aza, halogenated (fluoro, chloro, bromo, or iodo) or alkox can be substituted by aromatic amino acids including: 2-, 3- or 4-aminophenylalanine, 2-, 3- or 4-chlorophenylalanine, 2-, 3- or 4-methylphenylalanine, 2-, 3- or 4-methoxyphenylalanine, 5-amino-, 5-chloro-, 5-methyl- or 5-methoxytryptophan, 2'-, 3'-, or 4'-amino-, 2'-, 3'-, or 4'-chloro-, 2, 3, or 4-biphenylalanine, 2'-, 3'-, or 4'-methyl-, 2-, 3- or 4-biphenylalanine, and 2- or 3-pyridylalanine The amino acids comprising basic side chains, including arginine, lysine, histidine, ornithine, 2,3-diaminopropionic acid, homoarginine, including alkyl, alkenyl, or aryl-substituted derivatives of the previous amino acids, can be substituted. Examples are N-epsilon-isopropyl-lysine, 3-(4-tetrahydropyridyl)-glycine, 3-(4-tetrahydropyridyl)-alanine, N,N-gamma, gamma'-diethyl-homoarginine, alpha-methyl-arginine, alpha-methyl-2,3-diaminopropionic acid, alpha-methyl-histidine, and alpha-methyl-ornithine where the alkyl group occupies the pro-R position of the alpha-carbon. The modified IL-10 can comprise amides formed from any combination of alkyl, aromatic, heteroaromatic, ornithine, or 2,3-diaminopropionic acid, carboxylic acids or any of the many well-known activated derivatives such as acid chlorides, active esters, active azolides and related derivatives, lysine, and ornithine.

In some cases, IL-10 comprises can comprise one or more naturally occurring L-amino acids, synthetic L-amino acids, and/or D-enantiomers of an amino acid. The IL-10 polypeptide can comprise one or more of the following amino acids: ω-aminodecanoic acid, ω-aminotetradecanoic acid, cyclohexylalanine, α,γ-diaminobutyric acid, α,β-diaminopropionic acid, δ-amino valeric acid, t-butylalanine, t-butylglycine, N-methylisoleucine, phenylglycine, cyclohexylalanine, norleucine, naphthylalanine, ornithine, citrulline, 4-chlorophenylalanine, 2-fluorophenylalanine, pyridylalanine 3-benzothienyl alanine, hydroxyproline, β-alanine, o-aminobenzoic acid, m-aminobenzoic acid, p-aminobenzoic acid, m-aminomethylbenzoic acid, 2,3-diaminopropionic acid, α-aminoisobutyric acid, N-methylglycine(sarcosine), 3-fluorophenylalanine, 4-fluorophenylalanine, penicillamine, 1,2,3,4-tetrahydroisoquinoline-3-carboxylic acid, β-2-thienylalanine, methionine sulfoxide, homoarginine, N-acetyl lysine, 2,4-diamino butyric acid, rho-aminophenylalanine, N-methylvaline, homocysteine, homoserine, ε-amino hexanoic acid, w-aminohexanoic acid, w-aminoheptanoic acid, ω-aminooctanoic acid, and 2,3-diaminobutyric acid.

IL-10 can comprise a cysteine residue or a cysteine which can act as linker to another peptide via a disulfide linkage or to provide for cyclization of the IL-10 polypeptide. Methods of introducing a cysteine or cysteine analog are known in the art; see, e.g., U.S. Pat. No. 8,067,532. An IL-10 polypeptide can be cyclized. Other means of cyclization include introduction of an oxime linker or a lanthionine linker; see, e.g., U.S. Pat. No. 8,044,175. Any combination of amino acids (or non-amino acid moieties) that can form a cyclizing bond can be used and/or introduced. A cyclizing bond can be generated with any combination of amino acids (or with an amino acid and $—(CH_2)_nCO—$ or $—(CH_2)_nC_6H_4—CO—$) with functional groups which allow for the introduction of a bridge. Some examples are disulfides, disulfide mimetics such as the $—(CH_2)_n$-carba bridge, thioacetal, thioether bridges (cystathionine or lanthionine) and bridges containing esters and ethers.

The IL-10 can be substituted with an N-alkyl, aryl, or backbone crosslinking to construct lactams and other cyclic structures, C-terminal hydroxymethyl derivatives, o-modified derivatives, N-terminally modified derivatives including substituted amides such as alkylamides and hydrazides. In some cases, an IL-10 polypeptide is a retroinverso analog.

IL-10 can be IL-10 can be native protein, peptide fragment IL-10, or modified peptide, having at least a portion of the biological activity of native IL-10. IL-10 can be modified to improve intracellular uptake. One such modification can be attachment of a protein transduction domain. The protein transduction domain can be attached to the C-terminus of the IL-10. Alternatively, the protein transduction domain can be attached to the N-terminus of the IL-10. The protein transduction domain can be attached to IL-10 via covalent bond. The protein transduction domain can be chosen from any of the sequences listed in Table 4h.

TABLE 4h

Exemplary protein transduction domains

| SEQ ID NO | Amino Acid Sequence |
|---|---|
| 277 | YGRKKRRQRRR; |
| 278 | RRORRTSKLMKR |
| 279 | GWTLNSAGYLLGKINLKALAALAKKIL |
| 280 | KALAWEAKLAKALAKALAKHLAKALAKALKCEA |
| 281 | ROIKIWFQNRRMKWKK |
| 282 | YGRKKRRORRR |
| 283 | RKKRRQRRR |
| 284 | YGRKKRRORRR |
| 285 | RKKRRORR |
| 286 | YARAAARQARA |
| 287 | THRLPRRRRRR |
| 288 | GGRRARRRRRR |

The BP of the human or animal compositions are not limited to native, full-length polypeptides, but also include recombinant versions as well as biologically and/or pharmacologically active variants or fragments thereof. For example, the skilled worker will appreciate that various amino acid substitutions can be made in the BP to create variants without departing from the spirit of the invention with respect to the biological activity or pharmacologic properties of the BP. Examples of conservative substitutions for amino acids in polypeptide sequences are shown in Table 5. However, in embodiments of the BPXTEN in which the sequence identity of the BP is less than 100% compared to a specific sequence disclosed herein, the invention contemplates substitution of any of the other 19 natural L-amino acids for a given amino acid residue of the given BP, which can be at any position within the sequence of the BP, including adjacent amino acid residues. If any particular substitution results in an undesirable change in biological activity, then an alternative amino acid can be employed and the construct evaluated by the methods described herein, or using any of the techniques and guidelines for conservative and non-conservative mutations set forth, for instance, in U.S. Pat. No. 5,364,934, the contents of which is incorporated by reference in its entirety, or using methods generally known to those of skill in the art. In addition, variants can also include, for instance, polypeptides wherein one or more amino acid residues are added or deleted at the N- or C-terminus of the full-length native amino acid sequence of a BP that retains at least a portion of the biological activity of the native peptide.

TABLE 5

Exemplary conservative amino acid substitutions

| Original Residue | Exemplary Substitutions |
|---|---|
| Ala (A) | val; leu; ile |
| Arg (R) | lys; gin; asn |
| Asn (N) | gin; his; lys; arg |
| Asp (D) | glu |
| Cys (C) | ser |
| Gln (Q) | asn |
| Glu (E) | asp |
| Gly (G) | pro |
| His (H) | asn: gin: lys: arg |
| xIle (I) | leu; val; met; ala; phe: norleucine |
| Leu (L) | norleucine: ile: val; met; ala: phe |
| Lys (K) | arg: gin: asn |
| Met (M) | leu; phe; ile |
| Phe (F) | leu: val: ile; ala |
| Pro (P) | gly |
| Ser (S) | thr |
| Thr (T) | ser |
| Trp (W) | tyr |
| Tyr(Y) | trp: phe: thr: ser |
| Val (V) | ile; leu; met; phe; ala; norleucine |

In some embodiments, a BP incorporated into a BPXTEN polypeptide can have a sequence that exhibits at least about 80% sequence identity to a sequence from Tables 4a-4h, alternatively at least about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99%, or 100% sequence identity as compared with a sequence from Tables 4a-4h. In some embodiments, a BP incorporated into a BPXTEN can be a bispecific sequence comprising a first binding domain and a second binding domain, wherein the first binding domain, having specific binding affinity to a tumor-specific marker or an antigen of a target cell, exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to paired VL and VH sequences of an anti-CD3 antibody selected from Table 6f; and wherein the second binding domain, having specific binding affinity to an effector cell, exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to paired VL and VH sequences of an anti-target cell antibody selected from Table 6a. The BP of the foregoing embodiments can be evaluated for activity using assays or measured or determined parameters as described herein, and those sequences that retain at least about 40%, or about 50%, or about 55%, or about 60%, or about 70%, or about 80%, or about 90%, or about 95% or more activity compared to the corresponding native BP sequence would be considered suitable for inclusion in the human or animal BPXTEN. The BP found to retain a suitable level of activity can be linked to one or more XTEN polypeptides described hereinabove or anywhere else herein. In one embodiment, a BP found to retain a suitable level of activity can be linked to one or more XTEN polypeptides, having at least about 80% sequence identity (e.g., at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or 100% sequence identity) to a sequence from Tables 3a-3b, resulting in a chimeric fusion protein.

T Cell Engagers

Additional structural configuration formulae of BPXTEN relate to XTENylated Protease-Activated T Cell Engagers ("XPAT" or "XPATs"), wherein BP is a bispecific antibody (e.g., a bispecific T-cell engager). In some embodiments, the XPAT composition comprises a first portion comprising a first binding domain and a second binding domain, a second portion comprising the release segment, and a third portion comprising XTEN bulking moiety. In some embodiments, the XPAT composition has the configuration of Formula Ia (depicted N-terminus to C-terminus):

(first portion)-(second portion)-(third portion) (Ia)

wherein first portion is a bispecific comprising two scFv wherein the first binding domain has specific binding affinity to a tumor-specific marker or an antigen of a target cell and the second binding domain has specific binding affinity to an effector cell; the second portion comprises a release segment (RS) capable of being cleaved by a mammalian protease (as described more fully hereinbelow, the protease can be tumor- or antigen-specific, thereby activation); and the third portion is a bulking moiety. In the foregoing embodiment, the first portion binding domains can be in the order (VL-VH)1-(VL-VH)2, wherein "1" and "2" represent the first and second binding domains, respectively, or (VL-VH)1-(VH-VL)2, or (VH-VL)1-(VL-VH)2, or (VH-VL)1-(VH-VL)2, wherein the paired binding domains are linked by a polypeptide linker (as described more fully hereinbelow). In one embodiment, alternatives for the first portion VL and VH are identified in Tables 6a-6f; alternatives for RS are identified in the sequences set forth in Tables 8a-8b (as described more fully hereinbelow); and alternatives for the bulking moiety is identified herein by: XTEN; albumin binding domain; albumin; IgG binding domain; polypeptides consisting of proline, serine, and alanine; fatty acid; Fc domain; polyethylene glycol (PEG), PLGA; and hydoxylethyl starch. Where desired, the bulking moiety is an XTEN having at least about 90%, 91%, 92%, 93%, 94%, 95%, 96%, 97%, 98%, 99%, or 100% sequence identity to a sequence identified by the sequences set forth in Tables 3a-3b. In the foregoing embodiments, the composition is a recombinant fusion protein. In another embodiment, the portions are linked by chemical conjugation.

In another embodiment, the XPAT composition has the configuration of Formula IIa (depicted N-terminus to C-terminus):

(third portion)-(second portion)-(first portion) (IIa)

wherein first portion is a bispecific comprising two scFv wherein the first binding domain has specific binding affinity to a tumor-specific marker or an antigen of a target cell and the second binding domain has specific binding affinity to an effector cell; the second portion comprises a release segment (RS) capable of being cleaved by a mammalian protease; and the third portion is a bulking moiety. In the foregoing embodiment, the first portion binding domains can be in the order (VL-VH)1-(VL-VH)2, wherein "1" and "2" represent the first and second binding domains, respectively, or (VL-VH)1-(VH-VL)2, or (VH-VL)1-(VL-VH)2, or (VH-VL)1-(VH-VL)2, wherein the paired binding domains are linked by a polypeptide linker as described herein, below. In one embodiment, alternatives for the first portion VL and VH are identified in Tables 6a-6f; alternatives for RS are identified in the sequences set forth in Tables 8a-8b; and alternatives for the bulking moiety are identified herein by: XTEN; albumin binding domain; albumin; IgG binding domain; polypeptides consisting of proline, serine, and alanine; fatty acid; and Fc domain. Where desired, the bulking moiety is an XTEN having at least about 90%, 91%, 92%, 93%, 94%, 95%, 96%, 97%, 98%, 99%, or 100% sequence identity to a sequence selected from the group of sequences set forth in Tables 3a-3b. In the foregoing embodiments, the composition is a recombinant fusion protein. In another embodiment, the portions are linked by chemical conjugation.

In another embodiment, the XPAT composition has the configuration of Formula IIIa (depicted N-terminus to C-terminus):

(fifth portion)-(fourth portion)-(first portion)-(second portion)-(third portion) (IIIa)

wherein first portion is a bispecific comprising two scFv wherein the first binding domain has specific binding affinity to a tumor-specific marker or an antigen of a target cell and the second binding domain has specific binding affinity to an effector cell; the second portion comprises a release segment (RS) capable of being cleaved by a mammalian protease; the third portion is a bulking moiety; the fourth portion comprises a release segment (RS) capable of being cleaved by a mammalian protease which can be identical or different from the second portion; and the fifth portion is a bulking moiety that can be identical or can be different from the third portion. In the foregoing embodiment, the first portion binding domains can be in the order (VL-VH)1-(VL-VH)2, wherein "1" and "2" represent the first and second binding domains, respectively, or (VL-VH)1-(VH-VL)2, or (VH-VL)1-(VL-VH)2, or (VH-VL)1-(VH-VL)2, wherein the paired binding domains are linked by a polypeptide linker as described herein, below. In the foregoing embodiments, alternatives for RS are identified in the sequences set forth in Tables 8a-8b. In the foregoing embodiments, alternatives for the bulking moiety are identified herein by: XTEN; albumin binding domain; albumin; IgG binding domain; polypeptides consisting of proline, serine, and alanine; fatty acid; and Fc domain. Where desired, the bulking moiety is an XTEN having at least about 90%, 91%, 92%, 93%, 94%, 95%, 96%, 97%, 98%, 99%, or 100% sequence identity to a sequence selected from the group of sequences set forth in Tables 3a-3b. In the foregoing embodiments, the composition is a recombinant fusion protein. In another embodiment, the portions are linked by chemical conjugation.

The human or animal compositions, based on their design and specific components, advantageously provide bispecific therapeutics that have more selectivity, greater half-life, and result in less toxicity and fewer side effects once they are cleaved by proteases found in associated with the target tissues or tissues rendered unhealthy by a disease, wherein the human or animal compositions have improved therapeutic index compared to bispecific antibody compositions known in the art. Such compositions are useful in the treatment of certain diseases, including, but not limited to cancer as set forth herein. Without being limited to any mechanistic theory, the skilled worker will appreciate that the compositions of the instant invention achieve this reduction in non-specific interactions by a combination of mechanisms, which include steric hindrance by locating the binding domains to the bulky XTEN molecules, wherein flexible, unstructured characteristics of XTEN polypeptides, by being tethered to the composition, are able to oscillate and move around the binding domains, providing blocking between the composition and tissues or cells, as well as providing a reduction in the ability of the intact composition to penetrate a cell or tissue due to the large molecular mass (contributed to by both the actual molecular weight of the XTEN polypeptide(s) and due to the large hydrodynamic radius of the unstructured XTEN polypeptides) compared to the size of the individual binding domains. However, the compositions are designed wherein when in proximity to a target tissue or cell bearing or secreting a protease capable of cleaving the RS, or when internalized into a target cell or tissue when a binding domain has bound the ligand, the bispecific binding domains are liberated from the bulk of the XTEN by the action of the protease(s), removing the steric hindrance barrier, and is freer to exert its pharmacologic effect. The human or animal compositions find use in the treatment of a variety of conditions where selective delivery of a therapeutic bispecific antibody composition to a cell, tissue or organ is desired. In one embodiment, the target tissue is a cancer, which can be a leukemia, a lymphoma, or a tumor of an organ or system.

Binding Domains

The disclosure contemplates use of single chain binding domains, such as but not limited to Fv, Fab, Fab', Fab'-SH, $F(ab')_2$, linear antibodies, single domain antibody, single domain camelid antibody, single-chain antibody molecules (scFv), and diabodies capable of binding ligands or receptors associated with effector cells and antigens of diseased tissues or cells that are cancers, tumors, or other malignant tissues. In some embodiments, the bispecific antibody comprises a first binding domain with binding specificity to a target cell marker and a second binding domain with binding specificity to an effector cell antigen. In some embodiments, the first and the second binding domains can be non-antibody scaffolds such as anticalins, adnectins, fynomers, affilins, affibodies, centyrins, DARPins. In other embodiments, the binding domain for the tumor cell target is a variable domain of a T cell receptor that has been engineered to bind MHC that is loaded with a peptide fragment of a protein that is overexpressed by tumor cells. In some embodiments, the XPAT compositions are designed with considerations of the location of the target tissue protease as well as the presence of the same protease in healthy tissues not intended to be targeted, as well as the presence of the target ligand in healthy tissue but a greater presence of the ligand in unhealthy target tissue, in order to provide a wide therapeutic window. A "therapeutic window" refers to the largest difference between the minimal effective dose and the maximal tolerated dose for a given therapeutic composition. To help achieve a wide therapeutic window, the binding domains of the first portion of the compositions are shielded by the proximity of the bulking moiety (e.g., an XTEN polypeptide), wherein the binding affinity of the intact composition for one or both of the ligands is reduced compared to the composition that has been cleaved by a mammalian protease, thereby releasing the first portion from the shielding effects of the bulking moiety.

With respect to single chain binding domains, as is well established in the art FIT is the minimum antibody fragment which contains a complete antigen recognition and binding site, consisting of a dimer of one heavy (VH) and one light chain variable domain (VL) in non-covalent association. Within each VH and VL chain are three complementarity determining regions (CDRs) that interact to define an antigen binding site on the surface of the VH-VL dimer; the six CDRs of a binding domain confer antigen binding specificity to the antibody or single chain binding domain. In some cases, scFv are created in which each has 3, 4, or 5 CHRs within each binding domain. Framework sequences flanking the CDRs have a tertiary structure that is essentially conserved in native immunoglobulins across species, and the framework residues (FR) serve to hold the CDRs in their appropriate orientation. The constant domains are not required for binding function, but can aid in stabilizing VH-VL interaction. In some embodiments, the domain of the binding site of the polypeptide can be a pair of VH-VL, VH-VH or VL-VL domains either of the same or of different immunoglobulins, however it is generally preferred to make single chain binding domains using the respective VH and VL chains from the parental antibody. The order of VH and VL domains within the polypeptide chain is not limiting for the present invention; the order of domains given can be reversed usually without any loss of function, but it is understood that the VH and VL domains are arranged so that the antigen binding site can properly fold. Thus, the single chain binding domains of the bispecific scFv embodiments of the human or animal compositions can be in the order $(VL-VH)^1-(VL-VH)^2$, wherein "1" and "2" represent the first and second binding domains, respectively, or $(VL-VH)^1-(VH-VL)^2$, or $(VH-VL)^1-(VL-VH)^2$, or $(VH-VL)^1-(VH-VL)^2$, wherein the paired binding domains are linked by a polypeptide linker as described herein, below.

The arrangement of the binding domains in an exemplary bispecific single chain antibody disclosed herein can therefore be one in which the first binding domain is located C-terminally to the second binding domain. The arrangement of the V chains can be VH (target cell surface antigen)-VL(target cell surface antigen)-VL(effector cell antigen)-VH(effector cell antigen), VH(target cell surface antigen)-VL(target cell surface antigen)-VH(effector cell antigen)-VL(effector cell antigen), VL(target cell surface antigen)-VH(target cell surface antigen)-VL(effector cell antigen)-VH(effector cell antigen) or VL(target cell surface antigen)-VH(target cell surface antigen)-VH(effector cell antigen)-VL(effector cell antigen). For an arrangement, in which the second binding domain is located N-terminally to the first binding domain, the following orders are possible: VH (effector cell antigen)-VL(effector cell antigen)-VL(target cell surface antigen)-VH(target cell surface antigen), VH(effector cell antigen)-VL(effector cell antigen)-VH(target cell surface antigen)-VL(target cell surface antigen), VL(effector cell antigen)-VH(effector cell antigen)-VL(target cell surface antigen)-VH(target cell surface antigen) or VL(effector cell antigen)-VH(effector cell antigen)-VH(target cell surface antigen)-VL(target cell surface antigen). As used herein, "N-terminally to" or "C-terminally to" and grammatical variants thereof denote relative location within the primary amino acid sequence rather than placement at the absolute N- or C-terminus of the bispecific single chain antibody. Hence, as a non-limiting example, a first binding domain which is "located C-terminally to the second binding domain" denotes that the first binding is located on the carboxyl side of the second binding domain within the bispecific single chain antibody, and does not exclude the possibility that an additional sequence, for example a His-tag, or another compound such as a radioisotope, is located at the C-terminus of the bispecific single chain antibody.

In one embodiment, the chimeric polypeptide assembly compositions comprise a first portion comprising a first binding domain and a second binding domain wherein each of said binding domains is an scFv and wherein each scFv comprises one VL and one VH. In another embodiment, the chimeric polypeptide assembly compositions comprise a first portion comprising a first binding domain and a second binding domain wherein said binding domains are in a diabody configuration and wherein each domain comprises one VL domain and one VH. In the foregoing embodiments, the first domain has binding specificity to a tumor-specific marker or an antigen of a target cell and the second binding domain has binding specificity to an effector cell antigen. In one embodiment of the foregoing, the effector cell antigen is expressed on or within an effector cell. In one embodiment, the effector cell antigen is expressed on a T cell, such as a CD4+, CD8+, or natural killer (NK) cell. In another embodiment, the effector cell antigen is expressed on a B cell, master cell, dendritic cell, or myeloid cell. In one embodiment, the effector cell antigen is CD3, the cluster of differentiation 3 antigen of a cytotoxic T cell. In some embodiments of the foregoing, the first binding domain exhibits binding specificity to a tumor-specific marker associated with a tumor cell. In one embodiment, the binding domain has binding affinity to a tumor-specific marker wherein the tumor cell can include without limitation cells from stroma cell tumor, fibroblast tumor, myofibroblast tumor, glial cell tumor, epithelial cell tumor, fat cell tumor, immune cell tumor, vascular cell tumor, and smooth muscle cell tumor. In one embodiment, the tumor-specific marker or an antigen of a target cell can be alpha 4 integrin, Ang2, B7-H3, B7-H6, CEACAM5, cMET, CTLA4, FOLR1, EpCAM, CCR5, CD19, HER2, HER2 neu, HER3, HER4, HER1 (EGFR), PD-L1, PSMA, CEA, TROP-2, MUC1(mucin), MUC-2, MUC3, MUC4, MUC5AC, MUC5B, MUC7, MUC16 βhCG, Lewis-Y, CD20, CD33, CD38, CD30, CD56 (NCAM), CD133, ganglioside GD3; 9-O-Acetyl-GD3, GM2, Globo H, fucosyl GM1, GD2, carbonicanhydrase IX, CD44v6, Nectin-4, Sonic Hedgehog (Shh), Wue-1, plasma cell antigen 1, melanoma chondroitin sulfate proteoglycan (MCSP), CCR8, 6-transmembrane epithelial antigen of prostate (STEAP), mesothelin, A33 antigen, prostate stem cell antigen (PSCA), Ly-6, desmoglein 4, fetal acetylcholine receptor (fnAChR), CD25, cancer antigen 19-9 (CA19-9), cancer antigen 125 (CA-125), Muellerian inhibitory substance receptor type II (MISIIR), sialylated Tn antigen (s TN), fibroblast activation antigen (FAP), endosialin (CD248), epidermal growth factor receptor variant III (EGFRvIII), tumor-associated antigen L6 (TAL6), SAS, CD63, TAG72, Thomsen-Friedenreich antigen (TF-antigen), insulin-like growth factor I receptor (IGF-IR), Cora antigen, CD7, CD22, CD70, CD79a, CD79b, G250, MT-MMPs, F19 antigen, CA19-9, CA-125, alpha-fetoprotein (AFP), VEGFR1, VEGFR2, DLK1, SP17, ROR1, and EphA2. In one embodiment, the first binding domain that exhibits binding affinity to CD70 is its natural ligand, CD27 rather than an antibody fragment. In another embodiment, the first binding domain that exhibits binding affinity to B7-H6 is its natural ligand Nkp30 rather than an antibody fragment.

The scFv embodiments of the XPAT compositions of the invention comprise a first binding domain and a second binding domain wherein the VL and VH domains are derived from monoclonal antibodies with binding specificity to the tumor-specific marker or an antigen of a target cell and effector cell antigens, respectively. In other cases, the first and second binding domains each comprise six CDRs derived from monoclonal antibodies with binding specificity to a target cell marker, such as a tumor-specific marker and effector cell antigens, respectively. In other embodiments, the first and second binding domains of the first portion of the human or animal compositions can have 3, 4, or 5 CHRs within each binding domain. In other embodiments, the embodiments of the invention comprise a first binding domain and a second binding domain wherein each comprises a CDR-H1 region, a CDR-H2 region, a CDR-H3 region, a CDR-L1 region, a CDR-L2 region, and a CDR-H3 region, wherein each of said regions is derived from a monoclonal antibody capable of binding the tumor-specific marker or an antigen of a target cell, and effector cell antigens, respectively. In one embodiment, the invention provides a chimeric polypeptide assembly composition wherein the second binding domain comprises VH and VL regions derived from a monoclonal antibody capable of binding human CD3. In another embodiment, the invention provides a chimeric polypeptide assembly composition, wherein the scFv second binding domain comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of an anti-CD3 antibody set forth in Table 6a. In another aspect, the second domain embodiments of the invention comprise a CDR-H1 region, a CDR-H2 region, a CDR-H3 region, a CDR-L1 region, a CDR-L2 region, and a CDR-H3 region, wherein each of said regions is derived from a monoclonal antibody as set forth in Table 6a. In the foregoing embodiments, the VH and/or VL domains can be configured as scFv, diabodies, a single domain antibody, or a single domain camelid antibody.

In other embodiments, the second domains of the human or animal compositions are derived from an anti-CD3 antibody as set forth in Table 6a. In one embodiment of the foregoing, the second domain of the human or animal composition comprises the paired VL and the VH region sequences of the anti-CD3 antibody as set forth in Table 6a. In another embodiment, the invention provides a chimeric polypeptide assembly composition, wherein the second binding domain comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of the huUCHT1 anti-CD3 antibody of Table 6a. In the foregoing embodiments, the VH and/or VL domains can be configured as scFv, a portion of a diabody, a single domain antibody, or a single domain camelid antibody.

In other embodiments, the scFv of the first domain of the composition are derived from an anti-tumor cell antibody as set forth in Table 6f. In another embodiment, the invention provides a chimeric polypeptide assembly composition, wherein the first binding domain comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of an anti-tumor cell antibody as set forth in Table 6f. In one embodiment of the foregoing, the first domain of the recited compositions comprises the paired VL and the VH region sequences of an anti-tumor cell antibody disclosed herein. In the foregoing embodiments, the VH and/or VL domains can be configured as scFv, a portion of a diabody, a single domain antibody, or a single domain camelid antibody.

In another embodiment, the chimeric polypeptide assembly compositions comprise a first portion comprising a first binding domain and a second binding domain wherein said binding domains are in a diabody configuration and each of said binding domains comprises one VL domain and one VH domain. In one embodiment, the diabody embodiments of the invention comprise a first binding domain and a second binding domain wherein the VL and VH domains are derived from monoclonal antibodies with binding specificity to a tumor-specific marker or an antigen of a target cell, and the effector cell antigen, respectively. In another embodiment, the diabody embodiments of the invention comprise a first binding domain and a second binding domain wherein each comprises a CDR-H1 region, a CDR-H2 region, a CDR-H3 region, a CDR-L1 region, a CDR-L2 region, and a CDR-H3 region, wherein each of said regions is derived from a monoclonal antibody capable of binding the tumor-specific marker or target cell antigen, and the effector cell antigen, respectively. It is envisaged that the diabody embodiments of the invention comprise a first binding domain and a second binding domain wherein the VL and VH domains are derived from monoclonal antibodies with binding specificity to the tumor-specific marker or target cell antigen, and the effector cell antigen, respectively. In another aspect, the diabody embodiments of the invention comprise a first binding domain and a second binding domain wherein each comprises a CDR-H1 region, a CDR-H2 region, a CDR-H3 region, a CDR-L1 region, a CDR-L2 region, and a CDR-H3 region, wherein each of said regions is derived from a monoclonal antibody capable of binding the tumor-specific marker or target cell antigen, and the effector cell antigen, respectively. In one embodiment, the invention provides a chimeric polypeptide assembly composition wherein the diabody second binding domain comprises the paired VH and VL regions derived from a monoclonal antibody capable of binding human CD3. In another embodiment, the invention provides a chimeric polypeptide assembly composition, wherein the diabody second binding domain comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of an anti-CD3 antibody as set forth in Table 6a. In another embodiment, the invention provides a chimeric polypeptide assembly composition, wherein the diabody second binding domain comprises VH and VL regions wherein each VH and VL regions exhibit at least about 90%, or 91%, or 92%, or 93%, or 94%, or 95%, or 96%, or 97%, or 98%, or 99% identity to or is identical to the VL and a VH sequence of the huUCHT1 antibody as set forth in Table 6a. In other embodiments, the diabody second domain of the composition is derived from an anti-CD3 antibody described herein. In another embodiment, the invention provides a chimeric polypeptide assembly composition, wherein the diabody first binding domain comprises VH and VL regions wherein each VH and VL regions exhibit at least about 90%, or 91%, or 92%, or 93%, or 94%, or 95%, or 96%, or 97%, or 98%, or 99% identity to or is identical to VL and VH sequences of an anti-tumor cell antibody as set forth in Table 6f. In other embodiments, the diabody first domain of the composition is derived from an anti-tumor cell antibody described herein.

Therapeutic monoclonal antibodies from which VL and VH and CDR domains can be derived for the human or animal compositions are known in the art. The sequences for the above antibodies can be obtained from publicly available databases, patents, or literature references. In addition, non-limiting examples of monoclonal antibodies and VH and VL sequences from anti-CD3 antibodies set forth in Table 6a and non-limiting examples of monoclonal antibodies and VH and VL sequences to cancer, tumor, or target cell markers set forth in Table 6f.

Anti-CD3 Binding Domains

In some embodiments, the invention provides chimeric polypeptide assembly compositions comprising a binding domain of the first portion with binding affinity to T cells. In one embodiment, the binding domain of the second portion comprises VL and VH derived from a monoclonal antibody to an antigen of the CD3. In another embodiment, the binding domain comprises VL and VH derived from a monoclonal antibody to CD3epsilon and CD3delta. Monoclonal antibodies to CD3 neu are known in the art. Exemplary, non-limiting examples of VL and VH sequences of monoclonal antibodies to CD3 are set forth in Table 6a. In one embodiment, the invention provides a chimeric polypeptide assembly comprising a binding domain with binding affinity to CD3 comprising anti-CD3 VL and VH sequences set forth in Table 6a. In another embodiment, the invention provides a chimeric polypeptide assembly comprising a binding domain of the first portion with binding affinity to CD3epsilon comprising anti-CD3epsilon VL and VH sequences set forth in Table 6a. In another embodiment, the invention provides a chimeric polypeptide assembly composition, wherein the scFv second binding domain of the first portion comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of the huUCHT1 anti-CD3 antibody of Table 6a. In another embodiment, the invention provides a chimeric polypeptide assembly composition comprising a binding domain with binding affinity to CD3 comprising the CDR-L1 region, the CDR-L2 region, the CDR-L3 region, the CDR-H1 region, the CDR-H2 region, and the CDR-H3 region, wherein each is derived from the respective anti-CD3 VL and VH sequences set forth in Table 6a. In another embodiment, the invention provides a chimeric polypeptide assembly composition comprising a binding domain with binding affinity to CD3 comprising the CDR-L1 region, the CDR-L2 region, the CDR-L3 region, the CDR-H1 region, the CDR-H2 region, and the CDR-H3 region, wherein the CDR sequences are RASQDIRNYLN (SEQ ID NO: 8034), YTSRLES (SEQ ID NO: 8035), QQGNTLPWT (SEQ ID NO: 8036), GYSFTGYTMN (SEQ ID NO: 8037), LINPYKGVST (SEQ ID NO: 8038), and SGYYGDSDWYFDV (SEQ ID NO: 8039)

The CD3 complex is a group of cell surface molecules that associates with the T-cell antigen receptor (TCR) and functions in the cell surface expression of TCR and in the signaling transduction cascade that originates when a peptide: MHC ligand binds to the TCR. Typically, when an antigen binds to the T-cell receptor, the CD3 sends signals through the cell membrane to the cytoplasm inside the T cell. This causes activation of the T cell that rapidly divide to produce new T cells sensitized to attack the particular antigen to which the TCR were exposed. The CD3 complex is comprised of the CD3epsilon molecule, along with four other membrane-bound polypeptides (CD3-gamma, -delta, -zeta, and -beta). In humans, CD3-epsilon is encoded by the CD3E gene on Chromosome 11. The intracellular domains of each of the CD3 chains contain immunoreceptor tyrosine-based activation motifs (ITAMs) that serve as the nucleating point for the intracellular signal transduction machinery upon T cell receptor engagement.

A number of therapeutic strategies modulate T cell immunity by targeting TCR signaling, particularly the anti-human CD3 monoclonal antibodies (mAbs) that are widely used clinically in immunosuppressive regimes. The CD3-specific mouse mAb OKT3 was the first mAb licensed for use in humans (Sgro, C. Side-effects of a monoclonal antibody, muromonab CD3/orthoclone OKT3: bibliographic review. Toxicology 105:23-29, 1995) and is widely used clinically as an immunosuppressive agent in transplantation (Chatenoud, Clin. Transplant 7:422-430, (1993); Chatenoud, Nat. Rev. Immunol. 3:123-132 (2003); Kumar, Transplant. Proc. 30:1351-1352 (1998)), type 1 diabetes, and psoriasis. Importantly, anti-CD3 mAbs can induce partial T cell signaling and clonal anergy (Smith, JA, Nonmitogenic Anti-CD3 Monoclonal Antibodies Deliver a Partial T Cell Receptor Signal and Induce Clonal Anergy J. Exp. Med. 185:1413-1422 (1997)). OKT3 has been described in the literature as a T cell mitogen as well as a potent T cell killer (Wong, JT. The mechanism of anti-CD3 monoclonal antibodies. Mediation of cytolysis by inter-T cell bridging. Transplantation 50:683-689 (1990)). In particular, the studies of Wong demonstrated that by bridging CD3 T cells and target cells, one could achieve killing of the target and that neither FcR-mediated ADCC nor complement fixation was necessary for bivalent anti-CD3 MAB to lyse the target cells.

OKT3 exhibits both a mitogenic and T-cell killing activity in a time-dependent fashion; following early activation of T cells leading to cytokine release, upon further administration OKT3 later blocks all known T-cell functions. It is due to this later blocking of T cell function that OKT3 has found such wide application as an immunosuppressant in therapy regimens for reduction or even abolition of allograft tissue rejection. Other antibodies specific for the CD3 molecule are disclosed in Tunnacliffe, Int. Immunol. 1 (1989), 546-50, WO2005/118635 and WO2007/033230 describe anti-human monoclonal CD3 epsilon antibodies, U.S. Pat. No. 5,821,337 describes the VL and VH sequences of murine anti-CD3 monoclonal Ab UCHT1 (muxCD3, Shalaby et al., J. Exp. Med. 175, 217-225 (1992) and a humanized variant of this antibody (hu UCHT1), and United States Patent Application 20120034228 discloses binding domains capable of binding to an epitope of human and non-chimpanzee primate CD3 epsilon chain.

TABLE 6a

Anti-CD3 Monoclonal Antibodies and Sequences

| Clone Name | Antibody Name | Target | VH Sequence | SEQ ID NO: (full length) | SEQ ID NO: (CDRs) | VL Sequence | SEQ ID NO: (full length) | SEQ ID NO: (CDRs) |
|---|---|---|---|---|---|---|---|---|
| huOKT3 | | CD3 | QVQLVQSGGGV<br>VQPGRSLRLSCK<br>AS**GYTFTRYTM**<br>**H**WVRQAPGKGL<br>EWIG**YINPSRGY**<br>**TNYNQKVKD**RF<br>TISRDNSKNTAFL<br>QMDSLRPEDTGV<br>YFCAR**YYDDHY**<br>**CLDY**WGQGTPV<br>TVSS | 8040 | 8900,<br>8901,<br>8902 | DIQMTQSPSSL<br>SASVGDRVTI<br>TC**SASSSVSY**<br>**MN**WYQQTPG<br>KAPKRWIY**DT**<br>**SKLAS**GVPSR<br>FSGSGSGTDY<br>TFTISSLQPEDI<br>ATYYC**QQWS**<br>**SNPFT**FGQGT<br>KLQITR | 8049 | 8908,<br>8909,<br>8910 |
| huUCHT1 | | CD3 | EVQLVESGGGLV<br>QPGGSLRLSCAA<br>S**GYSFTGYTMN**<br>WVRQAPGKGLE<br>WVA**LINPYKGV**<br>**ST**YNQKFKDRFTI<br>SVDKSKNTAYLQ<br>MNSLRAEDTAVY<br>YCAR**SGYYGDS**<br>**DWYFDV**WGQGT<br>LVTVSS | 8041 | 8037,<br>8038,<br>8039 | DIQMTQSPSSL<br>SASVGDRVTI<br>TC**RASQDIRN**<br>**YLN**WYQQKP<br>GKAPKLLIY**Y**<br>**TSRLES**GVPS<br>RFSGSGSGTD<br>YTLTISSLQPE<br>DFATYYC**QQ**<br>**GNTLPWT**FG<br>QGTKVEIK | 8050 | 8034,<br>8035,<br>8036 |
| hu12F6 | | CD3 | QVQLVQSGGGV<br>VQPGRSLRLSCK<br>AS**GYTFTSYTM**<br>**H**WVRQAPGKGL<br>EWIG**YINPSSGY**<br>**TKYNQKFKD**RF<br>TISADKSKSTAFL<br>QMDSLRPEDTGV<br>YFCAR**WQDYDV**<br>**YFDY**WGQGTPV<br>TVSS | 8042 | 8903,<br>8904,<br>8905 | DIQMTQSPSSL<br>SASVGDRVT<br>MTC**RASSSVS**<br>**YMH**WYQQTP<br>GKAPKPWIY**A**<br>**TSNLAS**GVPS<br>RFSGSGSGTD<br>YTLTISSLQPE<br>DIATYYC**QQ**<br>**WSSNPPT**FGQ<br>GTKLQITR | 8051 | 8911,<br>8912,<br>8913 |
| mOKT3 | | CD3 | QVQLQQSGAELA<br>RPGASVKMSCKA<br>S**GYTFTRYTMH**<br>WVKQRPGQGLE<br>WIG**YINPSRGYT**<br>**NYNQKFKD**KAT<br>LTTDKSSSTAYM<br>QLSSLTSEDSAVY<br>YCAR**YYDDHYC**<br>**LDY**WGQGTTLT<br>VSS | 8043 | 8900,<br>8906,<br>8902 | QIVLTQSPAIM<br>SASPGEKVTM<br>TC**SASSSVSY**<br>**MN**WYQQKSG<br>TSPKRWIY**DT**<br>**SKLAS**GVPAH<br>FRGSGSGTSY<br>SLTISGMEAE<br>DAATYYC**QQ**<br>**WSSNPFT**FGS<br>GTKLEINR | 8052 | 8908,<br>8909,<br>8910 |

TABLE 6a-continued

Anti-CD3 Monoclonal Antibodies and Sequences

| Clone Name | Antibody Name | Target | VH Sequence | SEQ ID NO: (full length) | SEQ ID NO: (CDRs) | VL Sequence | SEQ ID NO: (full length) | SEQ ID NO: (CDRs) |
|---|---|---|---|---|---|---|---|---|
| MT103 | blin-atumomab | CD3 | DIKLQQSGAELARPGASVKMSCKTS**GYTFTRYTMH**WVKQRPGQGLEWIG**YINPSRGYTNYNQKFKD**KATLTTDKSSSTAYMQLSSLTSEDSAVYYCAR**YYDDHYCLDY**WGQGTTLTVSS | 8044 | 8900, 8906, 8902 | DIQLTQSPAIMSASPGEKVTMTC**RASSSVSYMN**WYQQKSGTSPKRWIY**DTSKVAS**GVPYRFSGSGSGTSYSLTISSMEAEDAATYYC**QQWSSNPLT**FGAGTKLELK | 8053 | 8914, 8915, 8916 |
| MT110 | solitomab | CD3 | DVQLVQSGAEVKKPGASVKVSCKAS**GYTFTRYTMH**WVRQAPGQGLEWIG**YINPSRGYTNYADSVKG**RFTITTDKSTSTAYMELSSLRSEDTATYYCARYYDDHYCLDYWGQGTTVTVSS | 8045 | 8900, 8907, 8902 | DIVLTQSPATLSLSPGERATLSC**RASQSVSYMN**WYQQKPGKAPKRWIY**DTSKVAS**GVPARFSGSGSGTDYSLTINSLEAEDAATYYC**QQWSSNPLT**FGGGTKVEIK | 8054 | 8917, 8915, 8916 |
| CD3.7 | | CD3 | EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS | 8046 | | QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL | 8055 | |
| CD3.8 | | CD3 | EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS | 8047 | | QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL | 8056 | |
| CD3.9 | | CD3 | EVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS | 773 | | ELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVL | 772 | |
| CD3.10 | | CD3 | EVKLLESGGGLVQPKGSLKLSCAASGFTFNTYAMNWVRQAPGKGLEWVARIRSKYNNYATYYADSVKDRF | 8048 | | QAVVTQESALTTSPGETVTLTCRSSTGAVTTSNYANWVQEKPDHLFTGLIGGTNKRAPG | 8057 | |

TABLE 6a-continued

Anti-CD3 Monoclonal Antibodies and Sequences

| Clone Name | Antibody Name | Target | VH Sequence | SEQ ID NO: (full length) | SEQ ID NO: (CDRs) | VL Sequence | SEQ ID NO: (full length) | SEQ ID NO: (CDRs) |
|---|---|---|---|---|---|---|---|---|
| | | | TISRDDSQSILYL QMNNLKTEDTA MYYCVRHGNFG NSYVSWFAYWG QGTLVTVSS | | | VPARFSGSLIG DKAALTITGA QTEDEAIYFC ALWYSNLWV FGGGTKLTVL | | |

*underlined sequences, if present, are CDRs within the VL and VH

Cd3 Cell Antigen Binding Fragments

In another aspect, the disclosure relates to antigen binding fragments (AF2) having specific binding affinity for an effector cell antigen that can be incorporated into any of the human or animal composition embodiments described herein. In some cases, the effector cell antigen is expressed on the surface of an effector cell selected from a plasma cell, a T cell, a B cell, a cytokine induced killer cell (CIK cell), a mast cell, a dendritic cell, a regulatory T cell (RegT cell), a helper T cell, a myeloid cell, and a NK cell.

Various AF2 that bind effector cell antigens have particular utility for pairing with an antigen binding fragment with binding affinity to EGFR antigens associated with a diseased cell or tissue in composition formats in order to effect cell killing of the diseased cell or tissue. Binding specificity can be determined by complementarity determining regions, or CDRs, such as light chain CDRs or heavy chain CDRs. In many cases, binding specificity is determined by light chain CDRs and heavy chain CDRs. A given combination of heavy chain CDRs and light chain CDRs provides a given binding pocket that confers greater affinity and/or specificity towards an effector cell antigen as compared to other reference antigens. The resulting bispecific compositions, having a first antigen binding fragment (AF1) to EGFR linked by a short, flexible peptide linker to a second antigen binding fragment (AF2) with binding specificity to an effector cell antigen are bispecific, with each antigen binding fragment having specific binding affinity to their respective ligands. The skilled worker will understand that in such compositions, an AF1 directed against an EGFR of a disease tissue is used in combination with a AF2 directed towards an effector cell marker in order to bring an effector cell in close proximity to the cell of a disease tissue in order to effect the cytolysis of the cell of the diseased tissue. Further, the AF1 and AF2 are incorporated into the specifically designed polypeptides comprising cleavable release segments and XTEN in order to confer prodrug characteristics on the compositions that becomes activated by release of the fused AF1 and AF2 upon the cleavage of the release segments when in proximity to the disease tissue having proteases capable of cleaving the release segments in one or more locations in the release segment sequence.

In one embodiment, the AF2 of the human or animal compositions has binding affinity for an effector cell antigen expressed on the surface of a T cell. In another embodiment, the AF2 of the human or animal compositions has binding affinity for CD3. In another embodiment, the AF2 of the human or animal compositions has binding affinity for a member of the CD3 complex, which includes in individual form or independently combined form all known CD3 subunits of the CD3 complex; for example, CD3 epsilon, CD3 delta, CD3 gamma, CD3 zeta, CD3 alpha and CD3 beta. In another embodiment, the AF2 has binding affinity for CD3 epsilon, CD3 delta, CD3 gamma, CD3 zeta, CD3 alpha or CD3 beta.

The origin of the antigen binding fragments contemplated by the disclosure can be derived from a naturally occurring antibody or fragment thereof, a non-naturally occurring antibody or fragment thereof, a humanized antibody or fragment thereof, a synthetic antibody or fragment thereof, a hybrid antibody or fragment thereof, or an engineered antibody or fragment thereof. Methods for generating an antibody for a given target marker are well known in the art. For example, the monoclonal antibodies can be made using the hybridoma method first described by Kohler et al., Nature, 256:495 (1975), or can be made by recombinant DNA methods (U.S. Pat. No. 4,816,567). The structure of antibodies and fragments thereof, variable regions of heavy and light chains of an antibody (VH and VL), single chain variable regions (scFv), complementarity determining regions (CDR), and domain antibodies (dAbs) are well understood. Methods for generating a polypeptide having a desired antigen binding fragment with binding affinity to a given antigen are known in the art.

The skilled worker will understand that use of the term "antigen binding fragments" for the composition embodiments disclosed herein is intended to include portions or fragments of antibodies that retain the ability to bind the antigens that are the ligands of the corresponding intact antibody. In such embodiments, the antigen binding fragment can be, but is not limited to, CDRs and intervening framework regions, variable or hypervariable regions of light and/or heavy chains of an antibody (VL, VH), variable fragments (Fv), Fab' fragments, F(ab')2 fragments, Fab fragments, single chain antibodies (scAb), VHH camelid antibodies, single chain variable fragment (scFv), linear antibodies, a single domain antibody, complementarity determining regions (CDR), domain antibodies (dAbs), single domain heavy chain immunoglobulins of the BHH or BNAR type, single domain light chain immunoglobulins, or other polypeptides known in the art containing a fragment of an antibody capable of binding an antigen. The antigen binding fragments having CDR-H and CDR-L can be configured in a (CDR-H)-(CDR-L) or a (CDR-H)-(CDR-L) orientation, N-terminus to C-terminus. The VL and VH of two antigen binding fragments can also be configured in a single chain diabody configuration; i.e., the VL and VH of the AF1 and AF2 configured with linkers of an appropriate length to permit arrangement as a diabody.

Various CD3 binding AF2 of the disclosure have been specifically modified to enhance their stability in the polypeptide embodiments described herein. Protein aggregation of antibodies continues to be a significant problem in their developability and remains a major area of focus in antibody production. Antibody aggregation can be triggered by partial unfolding of its domains, leading to monomer-monomer association followed by nucleation and aggregate growth. Although the aggregation propensities of antibodies and antibody-based proteins can be affected by the external experimental conditions, they are strongly dependent on the intrinsic antibody properties as determined by their sequences and structures. Although it is well known that proteins are only marginally stable in their folded states, it is often less well appreciated that most proteins are inherently aggregation-prone in their unfolded or partially unfolded states, and the resulting aggregates can be extremely stable and long-lived. Reduction in aggregation propensity has also been shown to be accompanied by an increase in expression titer, showing that reducing protein aggregation is beneficial throughout the development process and can lead to a more efficient path to clinical studies. For therapeutic proteins, aggregates are a significant risk factor for deleterious immune responses in patients, and can form via a variety of mechanisms. Controlling aggregation can improve protein stability, manufacturability, attrition rates, safety, formulation, titers, immunogenicity, and solubility. The intrinsic properties of proteins such as size, hydrophobicity, electrostatics and charge distribution play important roles in protein solubility. Low solubility of therapeutic proteins due to surface hydrophobicity has been shown to render formulation development more difficult and can lead to poor bio-distribution, undesirable pharmacokinetics behavior and immunogenicity in vivo. Decreasing the overall surface hydrophobicity of candidate monoclonal antibodies can also provide benefits and cost savings relating to purification and dosing regimens. Individual amino acids can be identified by structural analysis as being contributory to aggregation potential in an antibody, and can be located in CDR as well as framework regions. In particular, residues can be predicted to be at high risk of causing hydrophobicity issues in a given antibody. In one embodiment, the present disclosure provides an AF2 having the capability to specifically bind CD3 in which the AF2 has at least one amino acid substitution of a hydrophobic amino acid in a framework region relative to the parental antibody or antibody fragment wherein the hydrophobic amino acid is selected from isoleucine, leucine or methionine. In another embodiment, the CD3 AF2 has at least two amino acid substitutions of hydrophobic amino acids in one or more framework regions wherein the hydrophobic amino acids are selected from isoleucine, leucine or methionine.

Changes on a polypeptide's net electrical charge, in particularly with regard to the antibodies or antibody fragments comprising particular embodiments of the invention set forth herein, were taken into account in the design of the sequences of the AF2 of the embodiments described herein, wherein individual amino acid substitutions were made relative to the parental antibody utilized as the starting point. Relevant to these design considerations is the polypeptide's isoelectric point (pI), which is the pH at which the antibody or antibody fragment has no net electrical charge. An antibody or antibody fragment typically has a net positive charge which tends to correlate with increased blood clearance and tissue retention, with a generally shorter half-life, whereas a net negative charge results in decreased tissue uptake and a longer half-life. It is possible to manipulate this charge through mutations to the framework residues. The isoelectric point of a polypeptide can be determined mathematically (e.g., computationally) or experimentally by an in vitro assay. In some embodiments, the isoelectric points of the AF1 and AF2 are designed to be within a particular range of each other, thereby promoting stability.

In one embodiment, the present disclosure provides an AF2 for use in any of the polypeptide embodiments described herein comprising CDR-L and CDR-H, wherein the AF2 (a) specifically binds to cluster of differentiation 3 T cell receptor (CD3); and (b) comprises CDR-H1, CDR-H2, and CDR-H3, having amino acid sequences of SEQ ID NOS: 742, 743, and 744, respectively. In another embodiment, the present disclosure provides an AF2 for use in any of the polypeptide embodiments described herein comprising CDR-L and CDR-H, wherein the AF2 (a) specifically binds to cluster of differentiation 3 T cell receptor (CD3); (b) comprises CDR-H1, CDR-H2, and CDR-H3, having amino acid sequences of SEQ ID NOS: 742, 743, and 744, respectively; and (c) comprises CDR-L wherein the CDR-L comprises a CDR-L1 having an amino acid sequence of SEQ ID NOS: 735 or 736, a CDR-L2 having an amino acid sequence of SEQ ID NOS: 738 or 739, and a CDR-L3 having an amino acid sequence of SEQ ID NO:740. In another embodiment, the foregoing AF2 embodiments of the paragraph further comprises light chain framework regions (FR-L) and heavy chain framework regions (FR-H) wherein AF2 comprises a FR-L1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:746, a FR-L2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:747, a FR-L3 exhibiting at least 86%, 87%, 88%, 89%, 90%, 91%, 92%, 93%, 94%, 95%, 96%, 97%, 98%, 99% sequence identity or is identical to the amino acid sequence of any one of SEQ ID NOS:748-751, a FR-L4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:754, a FR-H1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:755 or SEQ ID NO:756, a FR-H2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:759, a FR-H3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:760; and a FR-H4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:764. In another embodiment, the AF2 for use in any of the polypeptide embodiments described herein comprises light chain framework regions (FR-L) and heavy chain framework regions (FR-H) wherein AF2 comprises a FR-L1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:746, a FR-L2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:747, a FR-L3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:748, FR-L4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:754, a FR-H1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:755, a FR-H2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:759, a FR-H3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:760; and a FR-H4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:764. In another embodiment, the AF2 for use in any of the polypeptide embodiments described herein comprises light chain framework regions (FR-L) and heavy chain framework regions (FR-H) wherein AF2 comprises a FR-L1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:746, a FR-L2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:747, a FR-L3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:749, a FR-L4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:754, a FR-H1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:755, a FR-H2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:759, a FR-H3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:760; and a FR-H4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:764. In another embodiment, the AF2 of the human or animal polypeptide embodiments described herein comprises light chain framework regions (FR-L) and heavy chain framework regions (FR-H) wherein AF2 comprises a FR-L1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:746, a FR-L2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:747, a FR-L3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:750, a FR-L4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:754, a FR-H1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:755, a FR-H2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:759, a FR-H3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:760, and a FR-H4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:764. In another embodiment, the AF2 of the human or animal polypeptide embodiments described herein comprises light chain framework regions (FR-L) and heavy chain framework regions (FR-H) wherein AF2 comprises a FR-L1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:746, a FR-L2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:747, a FR-L3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:751, a FR-L4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:754, a FR-H1 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:756, a FR-H2 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:759, a FR-H3 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:760, and a FR-H4 exhibiting at least 86%, 87%, 88%, 89%, 90%, 91%, 92%, 93%, 94%, 95%, 96%, 97%, 98%, 99% sequence identity or is identical to the amino acid sequence of SEQ ID NO:764.

In another embodiment, the present disclosure provides an AF2 for use in any of the polypeptide embodiments described herein wherein the AF2 comprises a variable heavy (VH) amino acid sequence having at least 90%, 91%, 92%, 93%, 94%, 95%, 96%, 97%, 98%, 99% sequence identity or is identical to an amino acid sequence of SEQ ID NO:766 or SEQ ID NO:769. In another embodiment, the present disclosure provides an AF2 for use in any of the polypeptide embodiments described herein wherein the AF2 comprises a variable light (VL) amino acid sequence having at least 90%, 91%, 92%, 93%, 94%, 95%, 96%, 97%, 98%, 99% sequence identity or is identical to an amino acid sequence of any one of SEQ ID NOS: 765, 767, 768, 770, or 771. In another embodiment, the present disclosure provides an AF2 for use in any of the polypeptide embodiments described herein wherein the AF2 comprises a variable heavy (VH) amino acid sequence having at least 90%, 91%, 92%, 93%, 94%, 95%, 96%, 97%, 98%, 99% sequence identity or is identical to an amino acid sequence of SEQ ID NO:766 or SEQ ID NO:769 and a variable light (VL) amino acid sequence having at least 90%, 91%, 92%, 93%, 94%, 95%, 96%, 97%, 98%, 99% sequence identity or is identical to an amino acid sequence of any one of SEQ ID NOS: 765, 767, 768, 770, or 771.

In another embodiment, the present disclosure provides an AF2 for use in any of the polypeptide embodiments described herein wherein the AF2 comprises an amino acid sequence having at least 95%, 96%, 97%, 98%, 99% sequence identity or is identical to an amino acid sequence of any one of SEQ ID NOS:776-780.

In another aspect, the present disclosure provides AF2 antigen binding fragments that bind to the CD3 protein complex that have enhanced stability compared to CD3 binding antibodies or antigen binding fragments known in the art. Additionally, the CD3 antigen binding fragments of the disclosure are designed to confer a higher degree of stability on the chimeric bispecific antigen binding fragment compositions into which they are integrated, leading to improved expression and recovery of the fusion protein, increased shelf-life and enhanced stability when administered to a human or animal. In one approach, the CD3 AF2 of the present disclosure are designed to have a higher degree of thermal stability compared to certain CD3-binding antibodies and antigen binding fragments known in the art. As a result, the CD3 AF2 utilized as components of the chimeric bispecific antigen binding fragment compositions into which they are integrated exhibit favorable pharmaceutical properties, including high thermostability and low aggregation propensity, resulting in improved expression and recovery during manufacturing and storage, as well promoting long serum half-life. Biophysical properties such as thermostability are often limited by the antibody variable domains, which differ greatly in their intrinsic properties. High thermal stability is often associated with high expression levels and other desired properties, including being less susceptible to aggregation (Buchanan A, et al. Engineering a therapeutic IgG molecule to address cysteinylation, aggregation and enhance thermal stability and expression. MAbs 2013; 5:255). Thermal stability is determined by measuring the "melting temperature" ($T_m$), which is defined as the temperature at which half of the molecules are denatured. The melting temperature of each heterodimer is indicative of its thermal stability. In vitro assays to determine $T_m$ are known in the art, including methods described in the Examples, below. The melting point of the heterodimer can be measured using techniques such as differential scanning calorimetry (Chen et al (2003) Pharm Res 20:1952-60; Ghirlando et al (1999) Immunol Lett 68:47-52). Alternatively, the thermal stability of the heterodimer can be measured using circular dichroism (Murray et al. (2002) J. Chromatogr Sci 40:343-9), or as described in the Examples, below.

Thermal denaturation curves of the CD3 binding fragments and the anti-CD3 bispecific antibodies comprising said anti-CD3 binding fragment and a reference binding of the present disclosure show that the constructs of the present disclosure are more resistant to thermal denaturation than the antigen binding fragment consisting of a sequence shown in SEQ ID NO:781 or a control bispecific antibody wherein said control bispecific antigen binding fragment comprises SEQ ID NO:781 and a reference antigen binding fragment that binds to an EGFR embodiment described herein. In one embodiment, the polypeptides of any of the human or animal composition embodiments described herein comprise an anti-CD3 AF2 of the embodiments described herein, wherein the $T_m$ of the AF2 is at least 2° C. greater, or at least 3° C. greater, or at least 4° C. greater, or at least 5° C. greater, or at least 6° C. greater, or at least 7° C. greater, or at least 8° C. greater, or at least 9° C. greater, or at least 10° C. greater than the $T_m$ of an antigen binding fragment consisting of a sequence of SEQ ID NO:781, as determined by an increase in melting temperature in an in vitro assay.

In another embodiment, the polypeptides of any of the human or animal composition embodiments described herein comprise an AF2 that specifically binds human or cyno CD3 with a dissociation constant ($K_d$) constant between about 10 nM and about 400 nM, or between about 50 nM and about 350 nM, or between about 100 nM and 300 nM, as determined in an in vitro antigen-binding assay comprising a human or cyno CD3 antigen. In another embodiment, the polypeptides of any of the human or animal composition embodiments described herein comprise an AF2 that specifically binds human or cyno CD3 with a dissociation constant ($K_d$) weaker than about 10 nM, or about 50 nM, or about 100 nM, or about 150 nM, or about 200 nM, or about 250 nM, or about 300 nM, or about 350 nM, or weaker than about 400 nM as determined in an in vitro antigen-binding assay. For clarity, an antigen binding fragment with a $K_d$ of 400 binds its ligand more weakly than one with a $K_d$ of 10 nM. In another embodiment, the polypeptides of any of the human or animal composition embodiments described herein comprise an AF2 that specifically binds human or cyno CD3 with at least 2-fold, 3-fold, 4-fold, 5-fold, 6-fold, 7-fold, 8-fold, 9-fold, or at least 10-fold weaker binding affinity than an antigen binding fragment consisting of an amino acid sequence of SEQ ID NO: 781, as determined by the respective dissociation constants ($K_d$) in an in vitro antigen-binding assays. In another embodiment, the present disclosure provides bispecific polypeptides comprising an AF2 that exhibits a binding affinity to CD3 that is at least 2-fold, 3-fold, 4-fold, 5-fold, 6-fold, 7-fold, 8-fold, 9-fold, 10-fold, 20-fold, 50-fold, 100-fold, or at least 1000-fold at weaker relative to that of the AF1 EGFR embodiments described herein that are incorporated into the human or animal polypeptides, as determined by the respective dissociation constants ($K_d$) in an in vitro antigen-binding assay. The binding affinity of the human or animal compositions for the target ligands can be assayed using binding or competitive binding assays, such as Biacore assays with chip-bound receptors or binding proteins or ELISA assays, as described in U.S. Pat. No. 5,534,617, assays described in the Examples herein, radio-receptor assays, or other assays known in the art. The binding affinity constant can then be determined using standard methods, such as Scatchard analysis, as described by van Zoelen, et al., Trends Pharmacol Sciences (1998) 19)12):487, or other methods known in the art.

In a related aspect, the present disclosure provides AF2 that bind to CD3 and are incorporated into chimeric, bispecific polypeptide compositions that are designed to have an isoelectric point (pI) that confer enhanced stability on the compositions of the disclosure compared to corresponding compositions comprising CD3 binding antibodies or antigen binding fragments known in the art. In one embodiment, the polypeptides of any of the human or animal composition embodiments described herein comprise AF2 that bind to CD3 wherein the AF2 exhibits a pI that is between 6.0 and 6.6, inclusive. In another embodiment, the polypeptides of any of the human or animal composition embodiments described herein comprise AF2 that bind to CD3 wherein the AF2 exhibits a pI that is at least 0.1, 0.2, 0.3, 0.4, 0.5, 0.6, 0.7, 0.8, 0.9, or 1.0 pH unit lower than the pI of a reference antigen binding fragment consisting of a sequence shown in SEQ ID NO: 781. In another embodiment, the polypeptides of any of the human or animal composition embodiments described herein comprise an AF2 that binds to CD3 fused to an AF1 that binds to an EGFR antigen wherein the AF2 exhibits a pI that is within at least 0.1, 0.2, 0.3, 0.4, 0.5, 0.6, 0.7, 0.8, 0.9, 1.0, 1.1, 1.2, 1.3, 1.4, or 1.5 pH units of the pI of the AF1 that binds EGFR antigen or an epitope thereof. In another embodiment, the polypeptides of any of the human or animal composition embodiments described herein comprise an AF2 that binds to CD3 fused to an AF1 that binds to an EGFR antigen wherein the AF2 exhibits a pI that is within at least about 0.1 to about 1.5, or at least about 0.3 to about 1.2, or at least about 0.5 to about 1.0, or at least about 0.7 to about 0.9 pH units of the pI of the AF1. It is specifically intended that by such design wherein the pI of the two antigen binding fragments are within such ranges, the resulting fused antigen binding fragments will confer a higher degree of stability on the chimeric bispecific antigen binding fragment compositions into which they are integrated, leading to improved expression and enhanced recovery of the fusion protein in soluble, non-aggregated form, increased shelf-life of the formulated chimeric bispecific polypeptide compositions, and enhanced stability when the composition is administered to a human or animal. State differently, having the AF2 and the AF1 within a relatively narrow pI range of can allow for the selection of a buffer or other solution in which both the AF2 and AF1 are stable, thereby promoting overall stability of the composition.

In certain embodiments, the VL and VH of the antigen binding fragments are fused by relatively long linkers, comprising 25, 26, 27, 28, 29, 30, 31, 32, 33, 34, or 35 hydrophilic amino acids that, when joined together, have a flexible characteristic. In one embodiment, the VL and VH of any of the scFv embodiments described herein are linked by relatively long linkers of hydrophilic amino acids that are GSGEGSEGEGGGEGSEGEGSGEGGEGEGSG (SEQ ID NO: 8058), TGSGEGSEGEGGGEGSEGEGSGEGGEGEGSGT (SEQ ID NO: 8059), GATPPETGAETESPGETTGGSAESEPPGEG (SEQ ID NO: 8060, or GSAAPTAGTTPSASPAPPTGGSSAAGSPST (SEQ ID NO: 8061). In another embodiment, the AF1 and AF2 are linked together by a short linker of hydrophilic amino acids having 3, 4, 5, 6, or 7 amino acids. In one embodiment, the short linker sequences are SGGGGS (SEQ ID NO: 8062), GGGGS (SEQ ID NO: 8063), GGSGGS (SEQ ID NO: 8064), GGS, or GSP. In another embodiment, the disclosure provides compositions comprising a single chain diabody in which after folding, the first domain (VL or VH) is paired with the last domain (VH or VL) to form one scFv and the two domains in the middle are paired to form the other scFv in which the first and second domains, as well as the third and last domains, are fused together by one of the foregoing short linkers and the second and the third variable domains are fused by one of the foregoing relatively long linkers. As will be appreciated by one of skill in the art, the selection of the short linker and relatively long linker is to prevent the incorrect pairing of adjacent variable domains, thereby facilitating the formation of the single chain diabody configuration comprising the VL and VH of the first antigen binding fragment and the second antigen binding fragment.

TABLE 6b

Exemplary CD3 CDR Sequences

| Construct | CDR REGION | Amino Acid Sequence | SEQ ID NO: |
|---|---|---|---|
| 3.23, 3.30, 3.31, 3.32 | CDR-L1 | RSS**N**GAVT**S**SNYAN | 735 |
| 3.24 | CDR-L1 | RSS**N**G**E**VTTSNYAN | 736 |
| 3.33, 3.9 | CDR-L1 | RSSTGAVTTSNYAN | 737 |
| 3.23, 3.30, 3.31, 3.32, 3.9, 3.33 | CDR-L2 | GTNKRAP | 738 |
| 3.24 | CDR-L2 | GT**I**KRAP | 739 |
| 3.23, 3.24, 3.30, 3.31, 3.32 | CDR-L3 | ALWY**P**NLWVF | 740 |
| 3.33, 3.9 | CDR-L3 | ALWYSNLWVF | 741 |
| 3.23, 3.24, 3.30, 3.31, 3.32, 3.9 | CDR-H1 | GFTFNTYAMN | 742 |
| 3.23, 3.24, 3.30, 3.31, 3.32, 3.9 | CDR-H2 | RIRSKYNNYATYYADSVKD | 743 |
| 3.23. 3.24, 3.30, 3.31, 3.32 | CDR-H3 | H**E**NFGNSYVSWFA**H** | 744 |
| 3.9 | CDR-H3 | HGNFGNSYVSWFAY | 745 |

TABLE 6c

Exemplary CD3 FR Sequences

| Construct | FR REGION | Amino Acid Sequence | SEQ ID NO: |
|---|---|---|---|
| 3.23, 3.24, 3.30, 3.31, 3.32, 3.9, 3.33 | FR-L1 | ELVVTQEPSLTVSPGGTVTLTC | 746 |
| 3.23, 3.24, 3.30, 3.31, 3.32, 3.9, 3.33 | FR-L2 | WVQQKPGQAPRGLIG | 747 |
| 3.23, 3.24 | FR-L3 | GTPARFSGSLLGGKAALTLSGVQPEDEA**V**YYC | 748 |
| 3.30 | FR-L3 | GTPARFSGS**S**LGGKAALTLSGVQPEDEA**V**YYC | 749 |
| 3.31 | FR-L3 | GTPARFSGSLLGG**S**AALTLSGVQPEDEA**V**YYC | 750 |
| 3.32 | FR-L3 | GTPARFSGS**S**LGG**S**AALTLSGVQPEDEA**V**YYC | 751 |

TABLE 6c-continued

| Exemplary CD3 FR Sequences | | | |
|---|---|---|---|
| Construct | FR REGION | Amino Acid Sequence | SEQ ID NO: |
| 3.9 | FR-L3 | GTPARFSGSLLGGKAALTLSGVQPEDEAEYYC | 752 |
| 3.33 | FR-L3 | GTPARFSGS**S**LGG**S**AALTLSGVQPEDEAEYYC | 753 |
| 3.23, 3.24, 3.30, 3.31, 3.32, 3.9 | FR-L4 | GGGTKLTVL | 754 |
| 3.23, 3.24 | FR-H1 | EVQLLESGGG**I**VQPGGSLKLSCAAS | 755 |
| 3.30, 3.31, 3.32 | FR-H1 | EVQL**Q**ESGGG**I**VQPGGSLKLSCAAS | 756 |
| 3.33 | FR-H1 | EVQL**Q**ESGGGLVQPGGSLKLSCAAS | 757 |
| 3.9 | FR-H1 | EVQLLESGGGLVQPGGSLKLSCAAS | 758 |
| 3.23, 3.24, 3.30, 3.31, 3.32, 3.9, 3.33 | FR-H2 | WVRQAPGKGLEWVA | 759 |
| 3.23, 3.24, 3.30, 3.31, 3.32 | FR-H3 | RFTISRDDSKNT**V**YLQMNNLKTEDTAVYYCVR | 760 |
| 3.9 | FR-H3 | RFTISRDDSKNTAYLQMNNLKTEDTAVYYCVR | 762 |
| 3.23, 3.24, 3.30, 3.31, 3.32, 3.9, 3.33 | FR-H4 | WGQGTLVTVSS | 764 |

TABLE 6d

| Exemplary VL & VH Sequences | | | |
|---|---|---|---|
| Construct | REGION | Amino Acid Sequence | SEQ ID NO: |
| 3.23 | VL | ELVVTQEPSLTVSPGGTVTLTCRSS**N**GAVT**S**SNYANWVQQKP GQAPRGLIGGTNKRAPGTPARFSGSLLGGKAALTLSGVQPED EA**V**YYCALWY**P**NLWVFGGGTKLTVL | 765 |
| 3.23, 3.24 | VH | EVQLLESGGG**I**VQPGGSLKLSCAASGFTFNTYAMNWVRQAP GKGLEWVARIRSKYNNYATYYADSVKDRFTISRDDSKNT**V**Y LQMNNLKTEDTAVYYCVRH**E**NFGNSYVSWFA**H**WGQGTLV TVSS | 766 |
| 3.24 | VL | ELVVTQEPSLTVSPGGTVTLTCRSS**NGE**VTTSNYANWVQQKP GQAPRGLIGGT**I**KRAPGTPARFSGSLLGGKAALTLSGVQPEDE A**V**YYCALWY**P**NLWVFGGGTKLTVL | 767 |
| 3.30 | VL | ELVVTQEPSLTVSPGGTVTLTCRSS**N**GAVT**S**SNYANWVQQKP GQAPRGLIGGTNKRAPGTPARFSGSSLGGKAALTLSGVQPED EA**V**YYCALWY**P**NLWVFGGGTKLTVL | 768 |
| 3.30, 3.31, 3.32 | VH | EVQL**Q**ESGGG**I**VQPGGSLKLSCAASGFTFNTYAMNWVRQAP GKGLEWVARIRSKYNNYATYYADSVKDRFTISRDDSKNT**V**Y LQMNNLKTEDTAVYYCVRH**E**NFGNSYVSWFA**H**WGQGTLV TVSS | 769 |
| 3.31 | VL | ELVVTQEPSLTVSPGGTVTLTCRSS**N**GAVT**S**SNYANWVQQKP GQAPRGLIGGTNKRAPGTPARFSGSLLGG**S**AALTLSGVQPED EA**V**YYCALWY**P**NLWVFGGGTKLTVL | 770 |
| 3.32 | VL | ELVVTQEPSLTVSPGGTVTLTCRSS**N**GAVT**S**SNYANWVQQKP GQAPRGLIGGTNKRAPGTPARFSGS**S**LGG**S**AALTLSGVQPED EA**V**YYCALWY**P**NLWVFGGGTKLTVL | 771 |
| 3.9 | VL | ELVVTQEPSLTVSPGGTVTLTCRSSTGAVTTSNYANWVQQKP GQAPRGLIGGTNKRAPGTPARFSGSLLGGKAALTLSGVQPED EAEYYCALWYSNLWVFGGGTKLTVL | 772 |
| 3.9 | VH | EVQLLESGGGLVQPGGSLKLSCAASGFTFNTYAMNWVRQAP GKGLEWVARIRSKYNNYATYYADSVKDRFTISRDDSKNTAY LQMNNLKTEDTAVYYCVRHGNFGNSYVSWFAYWGQGTLV TVSS | 773 |

TABLE 6d-continued

| Exemplary VL & VH Sequences | | | |
|---|---|---|---|
| Construct | REGION | Amino Acid Sequence | SEQ ID NO: |
| 3.33 | VL | ELVVTQEPSLTVSPGGTVTLTCRSSTGAVTTSNYANWVQQKPGQAPRGLIGGTNKRAPGTPARFSGSSLGGSAALTLSGVQPEDEAEYYCALWYSNLWVFGGGTKLTVL | 774 |
| 3.33 | VH | EVQLQESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS | 775 |

Table 6e: Exemplary scFv Sequences

Anti-EpCAM Binding Domains

In some embodiments, the invention provides chimeric polypeptide assembly compositions comprising a binding domain with binding affinity to the tumor-specific marker EpCAM. In one embodiment, the binding domain comprises VL and VH derived form a monoclonal antibody to EpCAM. Monoclonal antibodies to EpCAM are known in the art. Exemplary, non-limiting examples of EpCAM monoclonal antibodies and the VL and VH sequences thereof are set forth in Table 6f. In one embodiment, the invention provides a chimeric polypeptide assembly composition comprising a binding domain with binding affinity to the tumor-specific marker EpCAM comprising anti-EpCAM VL and VH sequences set forth in Table 6f. In another embodiment, the invention provides a chimeric polypeptide assembly composition, wherein the first portion first binding domain comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of the 4D5MUCB anti-EpCAM antibody set forth in Table 6f. In another embodiment, the invention provides a chimeric polypeptide assembly composition comprising a binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences set forth in Table 6f.

TABLE 6f

| Anti-target Cell Monoclonal Antibodies and Sequences | | | | | | | | |
|---|---|---|---|---|---|---|---|---|
| Trade Name | Antibody Name | Target | VH Sequence | SEQ ID NO: (full-length) | SEQ ID NO: (CDRs) | VL Sequence | SEQ ID NO: (full-length) | SEQ ID NO: (CDRs) |
| Tysabri ™ | natalizumab | Alpha 4 Integrin | QVQLVQSGAEVKKPGASVKVSCKASGFNIK**DTYIH**WVRQAPGQRLEWMG**RIDPANGYTKYDPKFQG**RVTITADTSASTAYMELSSLRSEDTAVYYCAR**EGYYGNYGVYAMDY**WGQGTLVTVSS | 8065 | 8918, 8919, 8920 | DIQMTQSPSSLSASVGDRVTITC**KTSQDINKYMA**WYQQTPGKAPRLLIH**YTSALQ**PGIPSRFSGSGSGRDYTFTISSLQPEDIATYYC**LQYDNLWT**FGQGTKVEIK | 8164 | 9178, 9179, 9180 |
| REGN910 | nesvacumab | Ang2 | EVQLVESGGGLVQPGGSLRLSCAAS**GFTFSSYDIH**WVRQATGKGLEWVSAI**GPAGDTYYPGSV**KGRFTISRENAKNSLYLQMNSLRAGDTAVYYCAR**GLITFGGLIAPFDY**WGQGTLVTVSS | 8066 | 8921, 8922, 8923 | EIVLTQSPGTLSLSPGERATLSCRA**SQSVSSTYLA**WYQQKPGQAPRLLIY**GASSRAT**GIPDRFSGSGSGTDFTLTISRLEPEDFAVYYC**QHYDNSQ**TFGQGTKVEIK | 8165 | 9181, 9182, 9183 |
| hMFE23 | | CEA | QVKLEQSGAEVVKPGASVKLSCKAS**GFNIKDS**YMHWLRQGPGQRLEWIGWI**DPENGD**TEYAPKFQGKATFTTDTSANTAYLGLSSLRPEDTAVYYCNE | 8067 | 8924, 8925, 8926 | ENVLTQSPSSMSASVGDRVNIACSA**SSSVS**YMHWFQQKPGKSPKLWIYSTSN**LAS**GVPSRFSGSGSGTDYSLTISSMQPEDAATYYCQQ**RSSYPL**TFGG | 8166 | 9184, 9185, 9186 |

TABLE 6f-continued

Anti-target Cell Monoclonal Antibodies and Sequences

| Trade Name | Antibody Name | Target | VH Sequence | SEQ ID NO: (full-length) | SEQ ID NO: (CDRs) | VL Sequence | SEQ ID NO: (full-length) | SEQ ID NO: (CDRs) |
|---|---|---|---|---|---|---|---|---|
| | | | G**TPTGPYYFD**YWGQGTLVTVSS | | | GTKLEIK | | |
| M5A (humanized T84.66) | | CEA | EVQLVESGGGLVQPGGSLRLSCAASGFNIK**DTYMH**WVRQAPGKGLEWVAR**IDPANGNSKYADSVKG**RFTISADTSKNTAYLQMNSLRAEDTAVYYCAP**FGYYVSDYAMAY**WGQGTLVTVSS | 8068 | 8927, 8928, 8929 | DIQLTQSPSSLSASVGDRVTITC**RAGESVDIFGVGFLH**WYQQKPGKAPKLLIY**RASNLES**GVPSRFSGSGSRTDFTLTISSLQPEDFATYYC**QQTNEDPYT**FGQGTKVEIK | 8167 | 9187, 9188, 9189 |
| M5B (human9 ized T84.66) | | CEA | EVQLVESGGGLVQPGGSLRLSCAASGFNIK**DTYMH**WVRQAPGKGLEWVA**RIDPANGNSKYVPKFQG**RATISADTSKNTAYLQMNSLRAEDTAVYYCAP**FGYYVSDYAMAY**WGQGTLVTVSS | 8069 | 8930, 8931, 8929 | DIQLTQSPSSLSASVGDRVTITC**RAGESVDIFGVGFLH**WYQQKPGKAPKLLIY**RASNLES**GVPSRFSGSGSRTDFTLTISSLQPEDFATYYC**QQTNEDPYT**FGQGTKVEIK | 8167 | 9187, 9188, 9189 |
| CEA-Cide | Labetuzumab (MN-14) | CEACAM5 | EVQLVESGGGVVQPGRSLRLSCSASGFDFT**TYWMS**WVRQAPGKGLEWIG**EIHPDSSTINYAPSLKD**RFTISRDNAKNTLFLQMDSLRPEDTGVYFCAS**LYFGFPWFAY**WGQGTPVTVSS | 8070 | 8932, 8933, 8934 | DIQLTQSPSSLSASVGDRVTITC**KASQDVGTSVA**WYQQKPGKAPKLLIY**WTSTRHT**GVPSRFSGSGSGTDFTFTISS**QQYSLYRS**FGQGTKVEIK | 8168 | 9190, 9191, 9192 |
| CEA-Scan | arcitumomab | CEACAM5 | EVKLVESGGGLVQPGGSLRLSCATS**GFTFTDYYMN**WVRQPPGKALEWLG**FIGNKANGYTTEYSAS**VKGRFTISRDKSQSILYLQMNTLRAEDSA**TYYCTRDR**GLRFYFDYWGQGTTLTVSS | 8071 | 8935, 8936, 8937 | QTVLSQSPAILSASPGEKVTMTC**RASSSVTYIHW**YQQKPGSSPKSWIYA**TSNLASG**VPARFSGSGSGTSYSLTISRVEAEDAATYYC**QHWSSKPPT**FGGGTKLEIKR | 8169 | 9193, 9194, 9195 |
| MT110 | | CEACAM5 | EVQLVESGGGLVQPGRSLRLSCAASGFTVS**SYWMH**WVRQAPGKGLEWVG**FIRNKANGGTTEYAASVKG**RFTISRDDSKNTLYLQMNSLRAEDTAVYYCAR**DRGLRFYFDY**WGQGTTVTVSS | 8072 | 8938, 8939, 8940 | QAVLTQPASLSASPGASASLTC**TLRRGINVGAYSIY**WYQQKPGSPPQYLLR**YKSDSDKQQGS**GVSSRFSASKDASANAGILLISGLQSEDEADYYC**MIWHSGASAV**FGGGTKLTVL | 8170 | 9196, 9197, 9198 |
| MT103 | blinatumomab | CD19 | QVQLQQSGAELVRPGSSVKISCKASGYAFS**SYWMN**WVKQRPGQGLEWIG**QIWPGDGDTNYNGKFKG**KATLTADES | 8073 | 8941, 8942, 8943 | DIQLTQSPASLAVSLGQRATISC**KASQSVDYDGDSY**LNWYQQIPGQPPKLLI**YDASNLVS**GIPPRFSGSGSGTDFTLNIH | 8171 | 9199, 9200, 9201 |

TABLE 6f-continued

Anti-target Cell Monoclonal Antibodies and Sequences

| Trade Name | Antibody Name | Target | VH Sequence | SEQ ID NO: (full-length) | SEQ ID NO: (CDRs) | VL Sequence | SEQ ID NO: (full-length) | SEQ ID NO: (CDRs) |
|---|---|---|---|---|---|---|---|---|
| | | | SSTAYMQLSSL ASEDSAVYFCA R**RETTTVGRY** **YYAMDY**WGQ GTTVTVSS | | | PVEKVDAATYH C**QQSTEDPWT** FGGGTKLEIK | | |
| Arzerra | ofat- umumab | CD20 | EVQLVESGGGL VQPGRSLRLSC AASGFTFND**YA** **MH**WVRQAPGK GLEWVS**TISWN** **SGSIGYADSVK** **G**RFTISRDNAK KSLYLQMNSLR AEDTALYYCAK **DIQYGNYYYG** **MDV**WGQGTTV TVSS | 8074 | 8944, 8945, 8946 | EIVLTQSPATLS LSPGERATLSC **RASQSVSSYLA** WYQQKPGQAP RLLIY**DASNRA** **T**GIP**A**RFSGSGS GTDFTLTISSLE PEDFAVYYC**QQ** **RSNWPIT**FG**Q**G TRLEIK | 8172 | 9202, 9203, 9204 |
| Bexxar ™ | tosit- umomab | CD20 | QAYLQQSGAEL VRPGASVKMSC KASGYTFT**SYN** **MH**WVKQTPRQ GLEWIGA**IYPG** **NGDTSYNQKF** **KG**KATLTVDKS SSTAYMQLSSL TSEDSAVYFCA RVVYYSNSYW YFDVWGTGTT VTVSG | 8075 | 8947, 8948, 8949 | QIVLSQSPAILS ASPGEKVTMTC **RASSSVSYMH** WYQQKPGSSPK PWIY**APSNLAS** GVP**A**RFSGSGS GTSYSLTISRVE AEDAATYYC**Q** **QWSFNPPT**FGA GTKLELK | 8173 | 9205, 9206, 9207 |
| GAZYVA | Obinut- uzumab | CD20 | QVQLVQSGAEV KKPGSSVKVSC KASGYAFS**YSW** **IN**WVRQAPGQ GLEWMG**RIFP** **GDGDTDYNGK** **FKG**RVTITADK STSTAYMELSS LRSEDTAVYYC AR**NVFDGYWL** **VY**WGQGTLVT VSS | 8076 | 8950, 8951, 8952 | DIVMTQTPLSLP VTPGEPASISC**R** **SSKSLLHSNGI** **TYLY**WYLQKP GQSPQLLIY**QM** **SNLVS**GVPDRF SGSGSGTDFTL KISRVEAEDVG VYYC**AQNLEL** **PYT**FGGGTKVE IK | 8174 | 9208, 9209, 9210 |
| | Ocrel- izumab/ 2H7 v16 | CD20 | EVQLVESGGGL VQPGGSLRLSC AAS**GYTFTSYN** MHWVRQAPGK GLEWVGA**IYPG** **NGDT**SYNQKF KGRFTISVDKS KNTLYLQMNSL RAEDTAVYYC ARV**VYYSNSY** **WYFDV**WGQGT LVTVSS | 8077 | 8953, 8954, 8949 | DIQMTQSPSSLS ASVGDRVTITC **RASSSVSYMH** WYQQKPGKAP KPLIY**APSNLAS** GVPSRFSGSGS GTDFTLTISSLQ PEDFATYYC**QQ** **WSFNPPT**FGG TKVEIK | 8175 | 8911, 9206, 9207 |
| Rituxan ™ | rituximab | CD20 | QVQLQQPGAEL VKPGASVKMSC KAS**GYTFTSYN** MHWVKQTPGR GLEWIGA**IYPG** **NGDT**SYNQKF KGKATLTADKS SSTAYMQLSSL TSEDSAVYYC**A** **RSTYYGGDWY** **FNV**WGAGTTV TVSA | 8078 | 8953, 8954, 8955 | QIVLSQSPAILS ASPGEKVTMTC RAS**SSVSY**IHW FQQKPGSSPKP WIY**ATSNLAS**G VPVRFSGSGSG TSYSLTISRVEA EDAATYYC**QQ** **WTSNPPT**FGGG TKLEIK | 8176 | 9211, 9212, 9213 |

TABLE 6f-continued

Anti-target Cell Monoclonal Antibodies and Sequences

| Trade Name | Antibody Name | Target | VH Sequence | SEQ ID NO: (full-length) | SEQ ID NO: (CDRs) | VL Sequence | SEQ ID NO: (full-length) | SEQ ID NO: (CDRs) |
|---|---|---|---|---|---|---|---|---|
| Zevalin ™ | ibritumomab tieuxetan | CD20 | QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSA | 8079 | 8953, 8956, 8949 | QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELK | 8173 | 8911, 9206, 9207 |
| Mylotarg | Gemtuzumab (hP67.6) | CD33 | QLVQSGAEVKKPGSSVKVSCKASGYTITDSNIHWVRQAPGQSLEWIGYIYPYNGGTDYNQKFKNRATLTVDNPTNTAYMELSSLRSEDTDFYYCVNGNPWLAYWGQGTLVTVSS | 8080 | 8957, 8958, 8959 | DIQLTQSPSTLSASVGDRVTITCRASESLDNYGIRFLTWFQQKPGKAPKLLMYAASNQGSGVPSRFSGSGSGTEFTLTISSLQPDDFATYYCQQTKEVPWSFGQGTKVEVK | 8177 | 9214, 9215, 9216 |
| Daratumumab | | CD38 | EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSS | 8081 | 8960, 8961, 8962 | EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIK | 8178 | 9217, 9218, 9219 |
| | 1F6 | CD70 | QIQLVQSGPEVKKPGETVKISCKASGYTFTNYGMNWVKQAPGKGLKWMGWINTYTGEPTYADAFKGRFAFSLETSASTAYLQINNLKNEDTATYFCARDYGDYGMDYWGQGTSVTVSS | 8082 | 8963, 8964, 8965 | DIVLTQSPASLAVSLGQRATISCRASKSVSTSGYSFMHWYQQKPGQPPKLLIYLASNLESGVPARFSGSGSGTDFTLNIHPVEEEDAATYYCQHSREVPWTFGGGTKLEIK | 8179 | 9220, 9221, 9222 |
| | 2F2 | CD70 | QVQLQQSGTELMTPGASVTMSCKTSGYTFSTYWIEWVKQRPGHGLEWIGEILGPSGYTDYNEKFKAKATFTADTSSNTAYMQLSSLASEDSAVYYCARWDRLYAMDYWGGGTSVTVSS | 8083 | 8966, 8967, 8968 | DIVLTQSPASLTVSLGQKTTISCRASKSVSTSGYSFMHWYQLKPGQSPKLLIYLASDLPSGVPARFSGSGSGTDFTLKIHPVEEEDAATYYCQHSREIPYTFGGGTKLEIT | 8180 | 9220, 9223, 9224 |
| | 2H5 | CD70 | QVQLVESGGGVVQPGRSLRLSCAASGFTFSSYIMHWVRQAPGKGLEWVAVISYDGRNKYYADSVKGRFTISRDNSKNTLYLQMNSL | 8084 | 8969, 8970, 8971 | EIVLTQSPATLSLSPGERATLSCRASQSVSSYLAWYQQKPGQAPRLLIYDASNRATGIPARFSGSGSGTDFTLTISSLEPEDFAVYYCQQ | 8181 | 9202, 9225, 9226 |

TABLE 6f-continued

Anti-target Cell Monoclonal Antibodies and Sequences

| Trade Name | Antibody Name | Target | VH Sequence | SEQ ID NO: (full-length) | SEQ ID NO: (CDRs) | VL Sequence | SEQ ID NO: (full-length) | SEQ ID NO: (CDRs) |
|---|---|---|---|---|---|---|---|---|
| | | | RAED TAVYYCAR**DT** **DGYDFDY**WGQ GTLVTVSS | | | R**TNWPLT**FGG GTKVEIK | | |
| | 10B4 | CD70 | QIQLVESGGGV VQPGRSLRLSC AASGFTFG**YYA** **MH**WVRQAPGK GLEWVA**VISYD** **GSIKYYADSVK** **G**RFTISRDNSK NTLYLQMNSLR AED TAVYYCAR**EG** **PYSNYLDY**WG QGTLVTVSS | 8085 | 8972, 8973, 8974 | AIQLTQSPSSLS ASVGDRVTITC **RASQGISSALA** WYQQKPGKAP KFLIY**DASSLES** GVPSRFSGSGS GTDFTLTISSLQ PEDFATYYC**QQ** **FNSYPFT**FGPG TKVDIK | 8182 | 9227, 9228, 9229 |
| | 8B5 | CD70 | QVQLVESGGGV VQPGRSLRLSC ATSGFTFS**DYG** **MH**WVRQAPGK GLEWVA**VIWY** **DGSNKYYADS** **VKG**RFTISRDN SKKTLSLQMNS LRAED TAVYYCAR**DSI** **MVRGDY**WGQ GTLVTVSS | 8086 | 8975, 8976, 8977 | DIQMTQSPSSLS ASVGDRVTITC **RASQGISSWLA** WYQQKPEKAP KSLIY**AASSLQS** GVPSRFSGSGS GTDFTLTISSLQ PEDFATYYC**QQ** **YNSYPLT**FGGG TKVEIK | 8183 | 9230, 9231, 9232 |
| | 18E7 | CD70 | QVQLVESGGGV VQPGRSLRLSC AASGFTFS**DHG** **MH**WVRQAPGK GLEWVA**VIWY** **DGSNKYYADS** **VKG**RFTISRDN SKNTLYLQMNS LRAED TAVYYCAR**DSI** **MVRGDY**WGQ GTLVTVSS | 8087 | 8978, 8976, 8977 | DIQMTQSPSSLS ASVGDRVTITC **RASQGISSWLA** WYQQKPEKAP KSLIY**AASSLQS** GVPSRFSGSGS GTDFTLTISSLQ PEDFATYYC**QQ** **YNSYPLT**FGGG TKVEIK | 8183 | 9230, 9231, 9232 |
| | 69A7 | CD70 | QVQLQESGPGL VKPSETLSLTCT VSGGSVSS**DYY** **YWS**WIRQPPGK GLEWLG**YIYYS** **GSTNYNPSLKS** RVTISVDTSKN QFSLKLRSVTT A DTAVYYCAR**G** **DGDYGGNCF**D YWGQGTLVTV SS | 8088 | 8979, 8980, 8981 | EIVLTQSPATLS LSPGERATLSC **RASQSVSSYLA** WYQQKPGQAP RLLIF**DASNRA** **T**GIPARFSGSGS GTDFTLTISSLE PEDFAVYYC**QQ** **RSNWPLT**FGG GTKVEIK | 8184 | 9202, 9203, 9233 |
| CE-355621 | | cMET | QVQLVQSGAEV KKPGASVKVSC KASGYTFT**SYG** **FS**WVRQAPGQ GLEWMG**WISA** **SNGNTYYAQK** **LQG**RVTMTTD TSTSTAYMELR SLRSDDTAVYY CAR**VYADYAD** **Y**WGQGTLVTV SS | 8089 | 8982, 8983, 8984 | DIQMTQSPSSVS ASVGDRVTITC **RASQGINTWL** **A**WYQQKPGKA PKLLIY**AASSLK** **S**GVPSRFSGSGS GTDFTLTISSLQ PEDFATYYC**QQ** **ANSFPLT**FGGG TKVEIK | 8185 | 9234, 9235, 9236 |

TABLE 6f-continued

Anti-target Cell Monoclonal Antibodies and Sequences

| Trade Name | Antibody Name | Target | VH Sequence | SEQ ID NO: (full-length) | SEQ ID NO: (CDRs) | VL Sequence | SEQ ID NO: (full-length) | SEQ ID NO: (CDRs) |
|---|---|---|---|---|---|---|---|---|
| LY2875358 | emibet-uzumab | CMET | QVQLVQSGAEV KKPGASVKVSC KAS**GYTFTDY YMH**WVRQAPG **Q**GLEWMGR**VN PNRRGTT**YNQ KFEGRVTMTTD TSTSTAYMELR SLRSDDTAVYY C**ARANWLDY** WGQGTTVTVSS | 8090 | 8985, 8986, 8987 | DIQMTQSPSSLS ASVGDRVTITC SVS**SSVSSIYLH** WYQQKPGKAP KLLIY**STSNLAS** GVPSRFSGSGS GTDFTLTISSLQ PEDFATYYC**QV YSGYPLT**FGGG TKVEIK | 8186 | 9237, 9238, 9239 |
| MetMAb | onart-uzumab | cMET | EVQLVESGGGL VQPGGSLRLSC AASGYTFT**SYW LH**WVRQAPGK GLEWVG**MIDPS NSDTRF**NPNFK DRFTISADTSKN TAYLQMNSLRA EDTAVYYC**AT YRSYVTPLDY** WGQGTLVTVSS | 8091 | 8988, 8989, 8990 | DIQMTQSPSSLS ASVGDRVTITC **KSSQSLLYTSS QKNYLA**WYQQ KPGKAPKLLIY **WASTRES**GVPS RFSGSGSGTDFT LTISSLQPEDFA TYYC**QQYYAY PWT**FGQGTKV EIK | 8187 | 9240, 9241, 9242 |
|  | tremel-imumab (CP-675206, or 11.2.1) | CTLA4 | QVQLVESGGGV VQPGRSLRLSC AAS**GFTFSSYG MH**WVRQAPGK GLEWVA**VIWY DGSNKYYADS** VKGRFTISRDNS KNTLYLQMNSL RAEDTAVYYC AR**DPRGATLY YYYYGMDV**W GQGTTVTVSS | 8092 | 8991, 8992, 8993 | DIQMTQSPSSLS ASVGDRVTITC **RASQSINSYLD** WYQQKPGKAP KLLIY**AASSLQS** GVPSRFSGSGS GTDFTLTISSLQ PEDFATYYC**QQ YYSTPFT**FGPG TKVEIK | 8188 | 9243, 9231, 9244 |
| Yervoy | Ipili-mumab 10D1 | CTLA4 | QVQLVESGGGV VQPGRSLRLSC AASGFTFS**SYT MH**WVRQAPGK GLEWVT**FISYD GNNKYYADSV KG**RFTISRDNS KNTLYLQMNSL RAEDTAIYYCA R**TGWLGPFDY** WGQGTLVTVSS | 8093 | 8994, 8995, 8996 | EIVLTQSPGTLS LSPGERATLSC **RASQSVGSSYL A**WYQQKPGQA PRLLIY**GAFSR AT**GIPDRFSGSG SGTDFTLTISRL EPEDFAVYYC**Q QYGSSPWT**FG QGTKVEIK | 8189 | 9245, 9246, 9247 |
| AGS16F | H16-7.8 | ENPP3 | QVQLQESGPGL VKPSQTLSLTCT VSGGSIS**SGGY YWS**WIRQHPG KGLEWIG**IIYYS GSTYYNPSLKS** RVTISVDTSKN QFSLKLNSVTA ADTAVFYCARV **AIVTTIPGGMD V**WGQGTTVTV SS | 8094 | 8997, 8998, 8999 | EIVLTQSPDFQS VTPKEKVTITC **RASQSIGISLH** WYQQKPDQSP KLLIK**YASQSFS** GVPSRFSGSGS GTDFTLTINSLE AEDAATYYC**H QSRSFPWT**FGQ GTKVEIK | 8190 | 9248, 9249, 9250 |
| MT110 | solitomab | EpCAM | EVQLLEQSGAE LVRPGTSVKISC KASGYAFT**NY WLG**WVKQRPG HGLEWIG**DIFP GSGNIHY**NEKF **KG**KATLTADKS SSTAYMQLSSL TFEDSAVYFCA R**LRNWDEPMD** | 8095 | 9000, 9001, 9002 | ELVMTQSPSSL TVTAGEKVTMS C**KSSQSLLNSG NQKNYL**TWYQ QKPGQPPKLLIY **WASTRES**GVP DRFTGSGSGTD FTLTISSVQAED LAVYYC**QNDY SYPLT**FGAGTK | 8191 | 9251, 9241, 9252 |

TABLE 6f-continued

Anti-target Cell Monoclonal Antibodies and Sequences

| Trade Name | Antibody Name | Target | VH Sequence | SEQ ID NO: (full-length) | SEQ ID NO: (CDRs) | VL Sequence | SEQ ID NO: (full-length) | SEQ ID NO: (CDRs) |
|---|---|---|---|---|---|---|---|---|
| | | | **Y**WGQGTTVTVSS | | | LEIK | | |
| MT201 | Adecat-umumab | EpCAM | EVQLLESGGGVVQPGRSLRLSCAASGFTFS**SYGMH**WVRQAPGKGLEWVA**VISYDGSNKYYADSVKG**RFTISRDNSKNTLYLQMNSLRAEDTAVYYCAK**DMGWGSGWRPYYYYGMDV**WGQGTTVTVSS | 8096 | 9003, 9004, 9005 | ELQMTQSPSSLSASVGDRVTITC**RTSQSISSYLN**WYQQKPGQPPKLLIY**WASTRES**GVPDRFSGSGSGTDFTLTISSLQPEDSATYYC**QQSYDIPYT**FGQGTKLEIK | 8192 | 9253, 9241, 9254 |
| Panorex | Edreco-lomab Mab CO17-1A | EpCAM | QVQLQQSGAELVRPGTSVKVSCKAS**GYAFTNYL**IEWVKQRPGQGLEWIGV**INPGSGGT**NYNEKFKGKATLTADKSSSTAYMQLSSLTSDDSAVYFC**ARDGPWFAY**WGQGTLVTVSA | 8097 | 9006, 9007, 9008 | NIVMTQSPKSMSMSVGERVTLTCKAS**ENVVTY**VSWYQQKPEQSPKLLIY**GAS**NRYTGVPDRFTGSGSATDFTLTISSVQAEDLADYHC**GQGYSYPYT**FGGGTKLEIK | 8193 | 9255, 9256, 9257 |
| | tucot-uzumab | EpCAM | QIQLVQSGPELKKPGETVKISCKAS**GYTFTNYGMN**WVRQAPGKGLKWMG**WINTYTGEPTYAD**DFKGRFVFSLETSASTAFLQLNNLRSEDTATYFCVRFI**SKGDY**WGQGTSVTVSS | 8098 | 8963, 9009, 9010 | QILLTQSPAIMSASPGEKVTMTC**SASSSVS**YMLWYQQKPGSSPKPWIF**DTSNLAS**GFPARFSGSGSGTSYSLIISSMEAEDAATYYC**HQRSGYPYT**FGGGTKLEIK | 8194 | 9258, 9259, 9260 |
| UBS-54 | | EpCAM | VQLQQSDAELVKPGASVKISCKAS**GYTFTDHAIH**WVKQNPEQGLEWIG**YFSPGNDDFKYNE**RFKGKATLTADKSSSTAYVQLNSLTSEDSAVYFCTR**SLNMAY**WGQGTSVTVSS | 8099 | 9011, 9012, 9013 | DIVMTQSPDSLAVSLGERATINC**KSSQSVLYSSNNKNYLA**WYQQKPGQPPKLLIY**WASTRES**GVPDRFSGSGSGTDFTLTISSLQAEDVAVYYCQ**QYYSYPLT**FGGGTKVKES | 8195 | 9261, 9241, 9262 |
| 3622W94 | 323/A3 | EpCAM | EVQLVQSGPEVKKPGASVKVSCKAS**GYTFTNYGMN**WVRQAPGQGLEWMG**WINTYTGEPTYGE**DFKGRFAFSLDTSASTAYMELSSLRSEDTAVYFCARFGN**YVDY**WGQGSLVTVSS | 8100 | 8963, 9014, 9015 | DIVMTQSPLSLPVTPGEPASISC**RSSINKKGSNGITY**LYWYLQKPGQSPQLLIYQMSNLASGVPDRF**SGSGS**GTDFTLKISRVEAEDVGVYYC**AQNLEIPRT**FGQGTKVEIK | 8196 | 9263, 9264, 9265 |
| 4D5MOCB v2 | | EpCAM | EVQLVQSGPGLVQPGGSVRISCAASGYTFT**NYGMN**WVKQAPGKGLEWMG**WINTYTGESTYADSFKG**RFTFSLDTSASAAYLQINSL | 8101 | 9016, 9017, 9018 | DIQMTQSPSSLSASVGDRVTITC**RSTKSLLHSNGITYLY**WYQQKPGKAPKLLIY**QMSNLAS**GVPSRFSSSGSGTDFTLTISSLQPEDFATY | 8197 | 9266, 9267, 9265 |

TABLE 6f-continued

Anti-target Cell Monoclonal Antibodies and Sequences

| Trade Name | Antibody Name | Target | VH Sequence | SEQ ID NO: (full-length) | SEQ ID NO: (CDRs) | VL Sequence | SEQ ID NO: (full-length) | SEQ ID NO: (CDRs) |
|---|---|---|---|---|---|---|---|---|
| | | | RAEDTAVYYCAR**FAIKGD**YWGQGTLLTVSS | | | YC**AQNLEIPRT**FGQGTKVEIK | | |
| 4D5MOCB | | EpCAM | EVQLVQSGPGLVQPGGSVRISCAASGYTFT**NYGMN**WVKQAPGKGLEWMG**WINTYTGESTYADSFKG**RFTFSLDTSASAAYLQINSLRAEDTAVYYCAR**FAIKGDY**WGQGTLLTVSS | 8101 | 9016, 9017, 9019 | DIQMTQSPSSLSASVGDRVTITC**RSTKSLLHSNGITYLY**WYQQKPGKAPKLLIY**QMSNLAS**GVPSRFSSSGSGTDFTLTISSLQPEDFATYYC**AQNLEIPRT**FGQGTKVELK | 8198 | 9266, 9267, 9265 |
| MEDI-547 | 1C1 | EphA2 | EVQLLESGGGLVQPGGSLRLSCAASGFTFS**HYMMA**WVRQAPGKGLEWVS**RIGPSGGPTHYADSVKG**RFTISRDNSKNTLYLQMNSLRAEDTAVYYCAGYDSG**YDYVAVAGPAEYFQH**WGQGTLVTVSS | 8102 | 9020, 9021, 9022 | DIQMTQSPSSLSASVGDRVTITC**RASQSISTWLA**WYQQKPGKAPKLLIY**KASNLHT**GVPSRFSGSGSGTEFSLTISGLQPDDFATYYC**QQYNSYSRT**FGQGTKVEIK | 8199 | 9268, 9269, 9270 |
| MORAb-003 | farletuzumab | FOLR1 | EVQLVESGGGVVQPGRSLRLSCSAS**GFTFSGYG**LSWVRQAPGKGLEWVAM**ISSGGSYT**YYADSVKGRFAISRDNAKNTLFLQMDSLRPEDTGVYFC**ARHGDDPAWF**AYWGQGTPVTVSS | 8103 | 9023, 9024, 9025 | DIQLTQSPSSLSASVGDRVTITCSVS**SSISSNN**LHWYQQKPGKAPKPWIY**GTS**NLASGVPSRFSGSGSGTDYTFTISSLQPEDIATYYC**QQWSSYPYMYT**FGQGTKVEIK | 8200 | 9271, 9272, 9273 |
| M9346A | huMOV19 (vLCv1.00) | FOLR1 | QVQLVQSGAEVVKPGASVKISCKASGYTFT**GYFMN**WVKQSPGQSLEWIG**RIHPYDGDTFYNQKFQG**KATLTVDKSSNTAHMELLSLTSEDFAVYYCTR**YDGSRAMDY**WGQGTTVTVSS | 8104 | 9026, 9027, 9028 | DIVLTQSPLSLAVSLGQPAIISC**KASQSVSFAGTSLMH**WYHQKPGQQPRLLIY**RASNLEA**GVPDRFSGSGSKTDFTLNISPVEAEDAATYYC**QQSREYPYT**FGGGTKLEIK | 8201 | 9274, 9275, 9276 |
| M9346A | huMOV19 (vLCv1.60) | FOLR1 | QVQLVQSGAEVVKPGASVKISCKASGYTFT**GYFMN**WVKQSPGQSLEWIG**RIHPYDGDTFYNQKFQG**KATLTVDKSSNTAHMELLSLTSEDFAVYYCTR**YDGSRAMDY**WGQGTTVTVSS | 8105 | 9026, 9027, 9029 | DIVLTQSPLSLAVSLGQPAIISC**KASQSVSFAGTSLMH**WYHQKPGQQPRLLIY**RASNLEA**GVPDRFSGSGSKTDFTLTISPVEAEDAATYYC**QQSREYPYT**FGGGTKLEIK | 8202 | 9274, 9275, 9276 |
| 26B3.F2 | | FOLR1 | GPELVKPGASVKISCKASDYSFT**GYFMN**WVMQSHGKSLEWIG**RIFPYNGDTFYNQKFKG**RATLT | 8106 | 9026, 9030, 9031 | PASLSASVGETVTITC**RTSENIFSYLA**WYQQKQGISPQLLVY**NAKTLAE**GVPSRFSGSGSGTQFSL | 8203 | 9277, 9278, 9279 |

TABLE 6f-continued

Anti-target Cell Monoclonal Antibodies and Sequences

| Trade Name | Antibody Name | Target | VH Sequence | SEQ ID NO: (full-length) | SEQ ID NO: (CDRs) | VL Sequence | SEQ ID NO: (full-length) | SEQ ID NO: (CDRs) |
|---|---|---|---|---|---|---|---|---|
| | | | VDKSSSTAHMELRSLASEDSAVYFCAR**GTHYFDY**WGQGTTLTVSS | | | KINSLQPEDFGSYYC**QHHYAFPWT**FGGGSKLEIK | | |
| RG7686 | GC33 | GPC3 | QVQLVQSGAEVKKPGASVKVSCKASGYTFT**DYEMH**WVRQAPGQGLEWMG**ALDPKTGDTAYSQKFKG**RVTLTADKSTSTAYMELSSLTSEDTAVYYCTR**FYSYTY**WGQGTLVTVSS | 8107 | 9032, 9033, 9034 | DVVMTQSPLSLPVTPGEPASISC**RSSQSLVHSNGNTYLH**WYLQKPGQSPQLLIY**KVSNRFS**GVPDRFSGSGSGTDFTLKISRVEAEDVGVYYC**SQNTHVPPT**FGQGTKLEIK | 8204 | 9280, 9281, 9282 |
| | 4A6 | GPC3 | EVQLVQSGAEVKKPGESLKISCKGSGYSFT**SYWIA**WVRQMPGKGLEWMG**IIFPGDSDTRYSPSFQG**QVTISADRSIRTAYLQWSSLKASDTALYYCART**REGYFDY**WGQGTLVTVSS | 8108 | 9035, 9036, 9037 | EIVLTQSPGTLSLSPGERATLSC**RAVQSVSSSYLA**WYQQKPGQAPRLLIY**GASSRAT**GIPDRFSGSGSGTDFTLTISRLEPEDFAVYYC**QQYGSSPT**FGGGTKVEIK | 8205 | 9283, 9182, 9284 |
| | 11E7 | GPC3 | EVQLVQSGAEVKKPGESLKISCKGSGYSFT**NYWIA**WVRQMPGKGLEWMG**IIYPGDSDTRYSPSFQG**QVTISADKSIRTAYLQWSSLKASDTAMYYCAR**TREGYFDY**WGQGTLVTVSS | 8109 | 9038, 9039, 9037 | EIVLTQSPGTLSLSPGERATLSC**RASQSVSSSYLA**WYQQKPGQAPRLLIY**GASSRAT**GIPDRFSGSGSGTDFTLTISRLEPEDFAVYYC**QQYGSSPT**FGGGTKVEIK | 8206 | 9285, 9182, 9284 |
| | 16D10 | GPC3 | EVQLVQSGADVTKPGESLKISCKVSGYRFT**NYWIG**WMRQMSGKGLEWMG**IIYPGDSDTRYSPSFQG**HVTISADKSINTAYLRWSSLKASDTAIYYCAR**TREGFFDY**WGQGTPVTVSS | 8110 | 9040, 9039, 9041 | EILLTQSPGTLSLSPGERATLSC**RASQSVSSSYLA**WYQQKPGQAPRLLIY**GASSRAT**GIPDRFSGSGSGTDFTLTISRLEPEDFAVYYC**QQYGSSPT**FGQGTKVEIK | 8207 | 9285, 9182, 9284 |
| AMG-595 | | HER1 (EGFR) | QVQLVESGGGVVQSGRSLRLSCAAS**GFTFRNYGMH**WVRQAPGKGLEW**VAVIWYDGSDKYYADSVRG**RFTISRDNSKNTLYLQMNSLRAEDTAVYYCARDGY**DILTGNPRDFDY**WGQGTLVTVSS | 8111 | 9042, 9043, 9044 | DTVMTQTPLSSHVTLGQPASISC**RSSQSLVHSDGNTYLS**WLQQRPGQPPRLLIY**RISRRFS**GVPDRFSGSGAGTDFTLEISRVEAEDVGVYYC**MQSTHVPRT**FGQGTKVEIK | 8208 | 9286, 9287, 9288 |

TABLE 6f-continued

Anti-target Cell Monoclonal Antibodies and Sequences

| Trade Name | Antibody Name | Target | VH Sequence | SEQ ID NO: (full-length) | SEQ ID NO: (CDRs) | VL Sequence | SEQ ID NO: (full-length) | SEQ ID NO: (CDRs) |
|---|---|---|---|---|---|---|---|---|
| Erubitux ™ | cetuximab | HER1 (EGFR) | QVQLKQSGPGLVQPSQSLSITCTVS**GFSLTNYG**VHWVRQSPGKGLEWLGV**IWSGGNT**DYNTPFTSRLSINKDNSKSQVFFKMNSLQSNDTAIYYC**ARALTYYDYEFAY**WGQGTLVTVSA | 8112 | 9045, 9046, 9047 | DILLTQSPVILSVSPGERVSFSCRAS**QSIGTN**IHWYQQRTNGSPRLLIK**YAS**ESISGIPSRFSGSGSGTDFTLSINSVESEDIADYYC**QQNNNWPTT**FGAGTKLELK | 8209 | 9289, 9290, 9291 |
| GA201 | Imgatuzumab | HER1 (EGFR) | QVQLVQSGAEVKKPGSSVKVSCKASGFTFT**DYKIH**WVRQAPGQGLEWMG**YFNPNSGYSTYAQKFQG**RVTITADKSTSTAYMELSSLRSEDTAVYYCAR**LSPGGYYVMDA**WGQGTTVTVSS | 8113 | 9048, 9049, 9050 | DIQMTQSPSSLSASVGDRVTITC**RASQGINNYLN**WYQQKPGKAPKRLIY**NTNNLQT**GVPSRFSGSGSGTEFTLTISSLQPEDFATYYC**LQHNSFPT**FGQGTKLEIK | 8210 | 9292, 9293, 9294 |
| Humax | zalutumumab | HER1 (EGFR) | QVQLVESGGGVVQPGRSLRLSCAASGFTFS**TYGMH**WVRQAPGKGLEWVAV**IWDDGSYKYYGDSVKG**RFTISRDNSKNTLYLQMNSLRAEDTAVYYCAR**DGITMVRGVMKDYFDY**WGQGTLVTVSS | 8114 | 9051, 9052, 9053 | AIQLTQSPSSLSASVGDRVTITC**RASQDISSALV**WYQQKPGKAPKLLIY**DASSLES**GVPSRFSGSESGTDFTLTISSLQPEDFATYYC**QQFNSYPLT**FGGGTKVEIK | 8211 | 9295, 9228, 9296 |
| IMC-11F8 | necitumumab | HER1 (EGFR) | QVQLQESGPGLVKPSQTLSLTCTVSGGSISS**GDYYWS**WIRQPPGKGLEWIG**YIYYSGSTDYNPSLKS**RVTMSVDTSKNQFSLKVNSVTAADTAVYYCAR**VSIFGVGTFDY**WGQGTLVTVSS | 8115 | 9054, 9055, 9056 | EIVMTQSPATLSLSPGERATLSC**RASQSVSSYLA**WYQQKPGQAPRLLIY**DASNRAT**GIPARFSGSGSGTDFTLTISSLEPEDFAVYYC**HQYGSTPLT**FGGGTKAEIK | 8212 | 9202, 9203, 9297 |
| MM-151 | P1X | HER1 (EGFR) | QVQLVQSGAEVKKPGSSVKVSCKASGGTFSS**YAIS**WVRQAPGQGLEWMG**SIIPIFGTVNYAQKFQG**RVTITADESTSTAYMELSSLRSEDTAVYYCAR**DPSVNLYWYFDL**WGRGTLVTVSS | 8116 | 9057, 9058, 9059 | DIQMTQSPSTLSASVGDRVTITC**RASQSISSWWA**WYQQKPGKAPKLLIY**DASSLES**GVPSRFSGSGSGTEFTLTISSLQPDDFATYYC**QQYHAHPTT**FGGGTKVEIK | 8213 | 9298, 9228, 9299 |
| MM-151 | P2X | HER1 (EGFR) | QVQLVQSGAEVKKPGSSVKVSCKASGGTFG**SYAIS**WVRQAPGQGLEWMG**SIIPIFGAANPAQKSQG**RVTITADESTSTAYMELSSLRSE | 8117 | 9057, 9060, 9061 | DIVMTQSPDSLAVSLGERATINC**KSSQSVLYSPNNKNYLA**WYQQKPGQPPKLLIY**WASTRES**GVPDRFSGSGSGTDFTLTISSLQAED | 8214 | 9300, 9241, 9301 |

TABLE 6f-continued

Anti-target Cell Monoclonal Antibodies and Sequences

| Trade Name | Antibody Name | Target | VH Sequence | SEQ ID NO: (full-length) | SEQ ID NO: (CDRs) | VL Sequence | SEQ ID NO: (full-length) | SEQ ID NO: (CDRs) |
|---|---|---|---|---|---|---|---|---|
| | | | DTAVYYCAK**MGRGKVAFDI**WGQGTMVTVSS | | | VAVYYC**QQYYGSPIT**FGGGTKVEIK | | |
| MM-151 | P3X | HER1 (EGFR) | QVQLVQSGAEVKKPGASVKVSCKASGYAFT**SYGIN**WVRQAPGQGLEWMG**WISAYNGNTYYAQKLRG**RVTMTTDTSTSTAYMELRSLRSDDTAVYYCAR**DLGGYGSGSVPFDP**WGQGTLVTVSS | 8118 | 9062, 9063, 9064 | EIVMTQSPATLSVSPGERATLSC**RASQSVSSNLA**WYQQKPGQAPRLLIY**GASTRAT**GIPARFSGSGSGTEFTLTISSLQSEDFAVYYC**QDYRTWPRRV**FGGGTKVEIK | 8215 | 9302, 9303, 9304 |
| TheraCIM | nimot-uzumab | HER1 (EGFR) | QVQLQQSGAEVKKPGSSVKVSCKASGYTFT**NYYIY**WVRQAPGQGLEWIG**GINPTSGGSNFNEKFKT**RVTITADESSTTAYMELSSLRSEDTAFYFCTR**QGLWFDSDGRGFDF**WGQGTTVTVSS | 8119 | 9065, 9066, 9067 | DIQMTQSPSSLSASVGDRVTITC**RSSQNIVHSNGNTYLD**WYQQTPGKAPKLLIY**KVSNRFS**GVPSRFSGSGSGTDFTFTISSLQPEDIATYYC**FQYSHVPWT**FGQGTKLQIT | 8216 | 9305, 9281, 9306 |
| Vectibix ™ | panit-umimab | HER1 (EGFR) | QVQLQESGPGLVKPSETLSLTCTVS**GGSVSSGDYY**WTWIRQSPGKGLEWIGH**IYYSGNT**NYNPSLKSRLTISIDTSKTQFSLKLSSVTAADTAIYYC**VRDRVTGAFDI**WGQGTMVTVSS | 8120 | 9068, 9069, 9070 | DIQMTQSPSSLSASVGDRVTITCQAS**QDISNY**LNWYQQKPGKAPKLLIY**DAS**NLETGVPSRFSGSGSGTDFTFTISSLQPEDIATYFC**QHFDHLPLA**FGGGTKVEIK | 8217 | 9307, 9218, 9308 |
| 07D06 | | HER1 (EGFR) | QIQLVQSGPELKKPGETVKISCKAS**GYTFTEYP**IHWVKQAPGKGFKWMGM**IYTDIGKP**TYAEEFKGRFAFSLETSASTAYLQINNLKNEDTATYFC**VRDRYDSLFDY**WGQGTTLTVSS | 8121 | 9071, 9072, 9073 | DVVMTQTPLSLPVSLGDQASISCRSS**QSLVHSNGNTY**LHWYLQKPGQSPKLLIY**KVSNR**FSGVPDRFSGSGSGTDFTLKISRVEAEDLGVYFC**SQSTHVPWT**FGGGTKLEIK | 8218 | 9309, 9310, 9311 |
| 12D03 | | HER1 (EGFR) | EMQLVESGGGFVKPGGSLKLSCAASGFAFS**HYDMS**WVRQTPKQRLEWVA**YIASGGDITYYADTVKG**RFTISRDNAQNTLYLQMSSLKSEDTAMFYCSR**SSYGNNGDALDF**WGQGTSVTVSS | 8122 | 9074, 9075, 9076 | DVVMTQTPLSLPVSLGDQASISC**RSSQSLVHSNGNTYLH**WYLQKPGQSPKLLIY**KVSNRFS**GVPDRFSGSGSGTDFTLKISRVEAEDLGVYFC**SQSTHVLT**FGSGTKLEIK | 8219 | 9280, 9281, 9312 |
| | C1 | HER2 | QVQLVESGGGLVQPGGSLRLSCAASGFTFS**SYAMG**WVRQAPGKGLEWVS**SISGSSRYIYYADSVKG** | 8123 | 9077, 9078, 9079 | QSPSFLSAFVGDRITITC**RASPGIRNYLA**WYQQKPGKAPKLLIY**AASTLQS**GVPSRFSGSGSGTDFTL | 8220 | 9313, 9314, 9315 |

TABLE 6f-continued

Anti-target Cell Monoclonal Antibodies and Sequences

| Trade Name | Antibody Name | Target | VH Sequence | SEQ ID NO: (full-length) | SEQ ID NO: (CDRs) | VL Sequence | SEQ ID NO: (full-length) | SEQ ID NO: (CDRs) |
|---|---|---|---|---|---|---|---|---|
| | | | RFTISRDNSKNTLYLQMNSLRAEDTAVYYCAK**MDASGSYFNF**WGQGTLVTVSS | | | TISSLQPEDFATYYC**QQYNSYPLS**FGGGTKVEIK | | |
| Erbicin | | HER2 | QVQLLQSAAEVKKPGESLKISCKGSGYSFT**SYWIG**WVRQMPGKGLEWMG**IIYPGDSDTRYSPSFQG**QVTISADKSISTAYLQWSSLKASDTAVYYCAR**WRDSPL**WGQGTLVTVSS | 8124 | 9080, 9039, 9081 | QAVVTQEPSFSVSPGGTVTLTC**GLSSGSVSTSYYPS**WYQQTPGQAPRTLIY**STNTRSS**GVPDRFSGSILGNKAALTITGAQADDESDYYC**VLYMGSGQYV**FGGGTKLTVL | 8221 | 9316, 9317, 9318 |
| Herceptin | trast-uzumab | HER2 | EVQLVESGGGLVQPGGSLRLSCAAS**GFNIKDTY**IHWVRQAPGKGLEWVAR**IYPTNGYT**RYADSVKGRFTISADTSKNTAYLQMNSLRAEDTAVYYC**SRWGGDGFYAMDY**WGQGTLVTVSS | 8125 | 9082, 9083, 9084 | DIQMTQSPSSLSASVGDRVTITCRAS**QDVNTA**VAWYQQKPGKAPKLLIY**SAS**FLYSGVPSRFSGSRSGTDFTLTISSLQPEDFATYYC**QQHYTTPPT**FGQGTKVEIK | 8222 | 9319, 9320, 9321 |
| MAGH22 | marget-uximab | HER2 | QVQLQQSGPELVKPGASLKLSCTAS**GFNIKDTY**IHWVKQRPEQGLEWIGR**IYPTNGYT**RYDPKFQDKATITADTSSNTAYLQVSRLTSEDTAVYYC**SRWGGDGFYAMDY**WGQGASVTVSS | 8126 | 9082, 9083, 9084 | DIVMTQSHKFMSTSVGDRVSITCKAS**QDVNTA**VAWYQQKPGHSPKLLIY**SAS**FRYTGVPDRFTGSRSGTDFTFTISSVQAEDLAVYYC**QQHYTTPPT**FGGGTKVEIK | 8223 | 9319, 9320, 9321 |
| MM-302 | F5 | HER2 | QVQLVESGGGLVQPGGSLRLSCAASGFTFR**SYAMS**WVRQAPGKGLEWVS**AISGRGDNTYYADSVKG**RFTISRDNSKNTLYLQMNSLRAEDTAVYYC**AKMTSNAFAFDY**WGQGTLVTVSS | 8127 | 9085, 9086, 9087 | QSVLTQPPSVSGAPGQRVTISC**TGSSSNIGAGYGVH**WYQQLPGTAPKLLIY**GNTNRPS**GVPDRFSGFKSGTSASLAITGLQAEDEADYYC**QFYDSSLSGWV**FGGGTKLTVL | 8224 | 9322, 9323, 9324 |
| Perjeta | pert-uzumab | HER2 | EVQLVESGGGLVQPGGSLRLSCAAS**GFTFTDYT**MDWVRQAPGKGLEWVAD**VNPNSGGS**IYNQRFKGRFTLSVDRSKNTLYLQMNSLRAEDTAVYYC**ARNLGPSFYFDY**WGQGTLVTVSS | 8128 | 9088, 9089, 9090 | DIQMTQSPSSLSASVGDRVTITCKASQ**DVSIG**VAWYQQKPGKAPKLLIY**SAS**YRYTGVPSRFSGSGSGTDFTLTISSLQPEDFATYYC**QQYYIYPYT**FGQGTKVEIK | 8225 | 9325, 9320, 9326 |
| MM-121/ SAR256212 | | HER3 | EVQLLESGGGLVQPGGSLRLSCAASGFTFS**HYVMA**WVRQAPGK | 8129 | 9091, 9092, 9093 | QSALTQPASVSGSPGQSITISC**TGTSSDVGSYNVV**SWYQQHPGK | 8226 | 9327, 9328. 9329 |

TABLE 6f-continued

Anti-target Cell Monoclonal Antibodies and Sequences

| Trade Name | Antibody Name | Target | VH Sequence | SEQ ID NO: (full-length) | SEQ ID NO: (CDRs) | VL Sequence | SEQ ID NO: (full-length) | SEQ ID NO: (CDRs) |
|---|---|---|---|---|---|---|---|---|
| | | | GLEWVS**SISSSG GWTLYADSVK G**RFTISRDNSK NTLYLQMNSLR AEDTAVYYCTR **GLKMATIFDY** WGQGTLVTVSS | | | APKLIIY**EVSQR PS**GVSNRFSGS KSGNTASLTISG LQTEDEADYYC **CSYAGSSIFVIF** GGGTKVTVL | | |
| MEHD7945A | Duligo-tumab | HER1 (EGFR)/ HER3 | EVQLVESGGGL VQPGGSLRLSC AASGFTLS**GDW IH**WVRQAPGK GLEWVG**EISAA GGYTDYADSV KG**RFTISADTS KNTAYLQMNS LRAEDTAVYYC AR**ESRVSFEAA MDY**WGQGTLV TVSS | 8130 | 9094, 9095, 9096 | DIQMTQSPSSLS ASVGDRVTITC **RASQNIATDVA** WYQQKPGKAP KLLIY**SASFLYS** GVPSRFSGSGS GTDFTLTISSLQ PEDFATYYC**QQ SEPEPYT**FGQG TKVEIK | 8227 | 9330, 9331, 9332 |
| MM-111 | | HER2/3 | QVQLQESGGGL VKPGGSLRLSC AASGFTFS**SYW MS**WVRQAPGK GLEWVA**NINR DGSASYYVDSV KG**RFTISRDDA KNSLYLQMNSL RAEDTAVYYC AR**DRGVGYFD L**WGRGTLVTVS S | 8131 | 9097, 9098, 9099 | QSALTQPASVS GSPGQSITISC**T GTSSDVGGYN FVS**WYQQHPG KAPKLMIYDVS DRPSGVSDRFS GSKSGNTASLII SGLQADDEADY YC**SSYGSSSTH VI**FGGGTKVTV L | 8228 | 9333, 9334, 9335 |
| MM-111 | | HER2/3 | QVQLVQSGAEV KKPGESLKISCK GSGYSFT**SYWI A**WVRQMPGKG LEYMG**LIYPGD SDTKYSPSFQG** QVTISVDKSVST AYLQWSSLKPS DSAVYFCAR**HD VGYCTDRTCA KWPEWLGV**W GQGTLVTVSS | 8132 | 9035, 9100, 9101 | QSVLTQPPSVS AAPGQ KVTISC**SGSSSN IGNNYVS**WYQ QLPGTAPKLLIY **DHTNRP**AGVP DRFSGSKSGTS ASLAISGFRSED EADYYC**ASWD YTLSGWV**FGG GTKLTVL | 8229 | 9336, 9337, 9338 |
| | Hu3S193 | Lewis-Y | EVQLVESGGGV VQPGRSLRLSC STSGFTFS**DYY MY**WVRQAPGK GLEWVA**YMSN VGAITDYPDTV KG**RFTISRDNS KNTLFLQMDSL RPEDTGVYFCA RGTRDGSWFA YWGQGTPVTV SS | 8133 | 9102, 9103, 9104 | DIQMTQSPSSLS ASVGDRVTITC **RSSQRIVHSNG NTYLE**WYQQT PGKAPKLLIY**K VSNRFS**GVPSR FSGSGSGTDFTF TISSLQPEDIAT YYC**FQGSHVPF T**FGQGTKLQIT | 8230 | 9339, 9281, 9340 |
| BAY 94-9343 | anetumab ravtan-sine | Mesothelin | QVELVQSGAEV KKPGESLKISCK GS**GYSFTSYW**I GWVRQAPGKG LEWMGI**IDPGD SRT**RYSPSFQG QVTISADKSIST AYLQWSSLKAS DTAMYYC**ARG QLYGGTYMDG** WGQGTLVTVSS | 8134 | 9105, 9106, 9107 | DIALTQPASVSG SPGQSITISCTGT **SSDIGGYNS**VS WYQQHPGKAP KLMIY**GVN**NRP SGVSNRFSGSK SGNTASLTISGL QAEDEADYYC**S SYDIESATPV**F GGGTKLTVL | 8231 | 9341, 9342, 9343 |

TABLE 6f-continued

Anti-target Cell Monoclonal Antibodies and Sequences

| Trade Name | Antibody Name | Target | VH Sequence | SEQ ID NO: (full-length) | SEQ ID NO: (CDRs) | VL Sequence | SEQ ID NO: (full-length) | SEQ ID NO: (CDRs) |
|---|---|---|---|---|---|---|---|---|
| | SS1 | Mesothelin | QVQLQQSGPEL EKPGASVKISC KASGYSFTGYT MNWVKQSHGK SLEWIGLITPYN GASSYNQKFRG KATLTVDKSSS TAYMDLLSLTS EDSAVYFCARG GYDGRGFDYW GQGTTVTVSS | 8135 | | DIELTQSPAIMS ASPGEKVTMTC SASSSVSYMHW YQQKSGTSPKR WIYDTSKLASG VPGRFSGSGSG NSYSLTISSVEA EDDATYYCQQ WSGYPLTFGAG TKLEIK | 8232 | |
| | | Mesothelin | QVYLVESGGGV VQPGRSLRLSC AASGITFS**IYG MH**WVRQAPGK GLEWVA**VIWY DGSHEYYADS VK**GRFTISRDN SKNTLYLLMNS LRAED TAVYYCARD**G DYYDSGSPLDY** WGQGTLVTVSS | 8136 | 9108, 9109, 9110 | EIVLTQSPATLS LSPGERATLSC **RASQSVSSYLA** WYQQKPGQAP RLLIY**DASNRA** TGIPARFSGSGS GTDFTLTISSLE PEDFAVYYC**QQ RSNWPLT**FGG GTKVEIK | 8233 | 9202, 9203, 9233 |
| | | Mesothelin | QVHLVESGGGV VQPGRSLRLSC VASGITF**RIYG MH**WVRQAPGK GLEWVA**VLWY DGSHEYYADS VK**GRFTISRDN SKNTLYLQMNS LRAED TAIYYCARD**GD YYDSGSPLDY** WGQGTLVTVSS | 8137 | 9111, 9112, 9110 | EIVLTQSPATLS LSPGERATLSC **RASQSVSSYLA** WYQQKPGQAP RLLIY**DASNRA** TGIPARFSGSGS GTDFTLTISSLE PEDFAVYYC**QQ RSNWPLT**FGG GTKVEIK | 8233 | 9202, 9203, 9233 |
| | | Mesothelin | EVHLVESGGGL VQPGGSLRLSC AASGFTFS**RYW MS**WVRQAQGK GLEWVA**SIKQA GSEKTYVDSV K**GRFTISRDNA KNSLSLQMNSL RAED TAVYYCAR**EG AYYYDSASYYP YYYYYSMDV**W GQGTTVTVSS | 8138 | 9113, 9114, 9115 | EIVLTQSPGTLS LSPGERATLSC **RASQSVSSSYL A**WYQQKPGQA PRLLIY**GASSRA** TGIPDRFSGSGS GTDFTLTISRLE PEDFAVYYC**Q QYGSSQYT**FGQ GTKLEIK | 8234 | 9285, 9182, 9344 |
| MORAb-009 | amat-uximab | Mesothelin | QVQLQQSGPEL EKPGASVKISC KASGYSFT**GYT MN**WVKQSHGK SLEWIG**LITPYN GASSYNQKFR G**KATLTVDKSS STAYMDLLSLT SEDSAVYFCAR **GGYDGRGFDY** WGSGTPVTVSS | 8139 | 9116, 9117, 9118 | DIELTQSPAIMS ASPGEKVTMTC **SASSSVSYMH** WYQQKSGTSPK RWIYDTSKLAS GVPGRFSGSGS GNSYSLTISSVE AEDDATYYC**Q QWSKHPLT**FG SGTKVEIK | 8235 | 9345, 8909, 9346 |
| hPAM4 | | MUC-1 | EVQLQESGPEL VKPGASVKMSC KASGYTFPS**YV LH**WVKQKPGQ GLEWIG**YINPY NDGTQYNEKF K**GKATLTSDKS SSTAYMELSRL | 8140 | 9119, 9120, 9121 | DIVMTQSPAIM SASPGEKVTMT C**SASSSVSSSYL Y**WYQQKPGSSP KLWIY**STSNLA S**GVPARFSGSG SGTSYSLTISSM EAEDAASYFC**H** | 8236 | 9347, 9348, 9349 |

TABLE 6f-continued

Anti-target Cell Monoclonal Antibodies and Sequences

| Trade Name | Antibody Name | Target | VH Sequence | SEQ ID NO: (full-length) | SEQ ID NO: (CDRs) | VL Sequence | SEQ ID NO: (full-length) | SEQ ID NO: (CDRs) |
|---|---|---|---|---|---|---|---|---|
| | | | TSEDSAVYYCARGFGGSYGFAYWGQGTLITVSA | | | QWNRYPYTFGGGTKLEIK | | |
| hPAM4-Cide | cliva-tuzumab | MUC1 | QVQLQQSGAEVKKFGASVKVSCEASGYTFPSYVLHWVKQAPGQGLEWIGYINPYNDGTQTNKKFKGKATLTRDTSINTAYMELSRLRSDDTAVYYCARGFGGSYGFAYNGQGTLVTVSS | 8141 | 9119, 9122, 9121 | DIQLTQSPSSLSASVGDRVTMTCSASSSVSSSYLYWYQQKPGKAPKLWIYSTSNLASGVPARFSGSGSGTDFTLTISSLQPEDSASYFCHQWNRYPYTFGGGTRLEIK | 8237 | 9347, 9348, 9349 |
| SAR566658 | huDS6v1.01 | MUC1 | QAQLQVSGAEVVKPGASVKMSCKASGYTFTSYNMHWVKQTPGQGLEWIGYIYPGNGATNYNQKFQGKATLTADTSSSTAYMQISSLTSEDSAVYFCARGDSVPFAYWGQGTLVTVSA | 8142 | 8947, 9123, 9124 | EIVLTQSPATMSASPGERVTITCSAHSSVSFMHWFQQKPGTSPKLWIYSTSSLASGVPARFGGSGSGTSYSLTISSMEAEDAATYYCQQRSSFPLTFGAGTKLELK | 8238 | 9350, 9351, 9352 |
| Theragyn | Pemt-umomab muHMFG1 | MUC1 | QVQLQQSGAELMKPGASVKISCKATGYTFSAYWIEWVKQRPGHGLEWIGEILPGSNNSRYNEKFKGKATFTADTSSNTAYMQLSSLTSEDSAVYYCSRSYDFAWFAYWGQGTPVTVSA | 8143 | 9125, 9126, 9127 | DIVMSQSPSSLAVSVGEKVTMSCKSSQSLLYSSNQKIYLAWYQQKPGQSPKLLIYWASTRESGVPDRFTGGGSGTDFTLTISSVKAEDLAVYYCQQYYRYPRTFGGGTKLEIK | 8239 9354, 9355 | 9353, |
| Therex | Sont-uzumab huHMFG1 AS1402 R1150 | MUC1 | QVQLVQSGAEVKKPGASVKVSCKASGYTFSAYWIEWVRQAPGKGLEWVGEILPGSNNSRYNEKFKGRVTVTRDTSTNTAYMELSSLRSEDTAVYYCARSYDFAWFAYWGQGTLVTVSS | 8144 | 9125, 9126, 9127 | DIQMTQSPSSLSASVGDRVTITCKSSQSLLYSSNQKIYLAWYQQKPGKAPKLLIYWASTRESGVPSRFSGSGSGTDFTFTISSLQPEDIATYYCQQYYRYPRTFGQGTKVEIK | 8240 | 9353, 9354, 9355 |
| MDX-1105 or BMS-936559 | | PD-L1 | QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS | 8145 | 9128, 9129, 9130 | EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK | 8241 | 9202, 9203, 9356 |
| MEDI-4736 | durva-lumab | PD-L1 | EVQLVESGGGLVQPGGSLRLSCAASGFTFSRYWMSWVRQAPGKGLEWVANIK | 8146 | 9131, 9132, 9133 | EIVLTQSPGTLSLSPGERATLSCRASQRVSSSYLAWYQQKPGQAPRLLIYDASSRAT | 8242 | 9357, 9218, 9358 |

TABLE 6f-continued

Anti-target Cell Monoclonal Antibodies and Sequences

| Trade Name | Antibody Name | Target | VH Sequence | SEQ ID NO: (full-length) | SEQ ID NO: (CDRs) | VL Sequence | SEQ ID NO: (full-length) | SEQ ID NO: (CDRs) |
|---|---|---|---|---|---|---|---|---|
| | | | QDGSEKYYVDSVKGRFTISRDNAKNSLYLQMNSLRAEDTAVYYCAREGGWFGELAFDYWGQGTLVTVSS | | | GIPDRFSGSGSGTDFTLTISRLEPEDFAVYYCQQYGSLPWTFGQGTKVEIK | | |
| MPDL3280A | atezol-izumab | PD-L1 | EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSS | 8147 | 9134, 9135, 9136 | DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK | 8243 | 9359, 9320, 9360 |
| MSB0010718C | avelumab | PD-L1 | EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSS | 8148 | 9137, 9138, 9139 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL | 8244 | 9361, 9362, 9363 |
| MLN591 | | PSMA | EVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSS | 8149 | 9140, 9141, 9142 | DIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIK | 8245 | 9364, 9365, 9232 |
| MT112 | pasot-uxizumab | PSMA | QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSS | 8150 | 9143, 9144, 9145 | DIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIK | 8246 | 9366, 9320, 9367 |
| | | ROR1 | QEQLVESGGRLVTPGGSLTLSCKASGFDFSAYYMSWVRQAPGKGLEWIATIYPSSGKTYYATWVNGRFTISSDNAQNTVDLQMNSLTAADRATYFCARDSYADDGALFNIWGPGTLVTISS | 8151 | 9146, 9147, 9148 | ELVLTQSPSVSAALGSPAKITCTLSSAHKTDTIDWYQQLQGEAPRYLMQVQSDGSYTKRPGVPDRFSGSSSGADRYLIIPSVQADDEADYYCGADYIGGYVFGGGTQLTVTG | 8247 | 9368, 9369, 9370 |
| | | ROR1 | EVKLVESGGGLVKPGGSLKLSCAASGFTFSSYA | 8152 | 9085, 9149, 9150 | DIKMTQSPSSMYASLGERVTITCKASPDINSYLS | 8248 | 9371, 9372, 9373 |

TABLE 6f-continued

Anti-target Cell Monoclonal Antibodies and Sequences

| Trade Name | Antibody Name | Target | VH Sequence | SEQ ID NO: (full-length) | SEQ ID NO: (CDRs) | VL Sequence | SEQ ID NO: (full-length) | SEQ ID NO: (CDRs) |
|---|---|---|---|---|---|---|---|---|
| | | | **MS**WVRQIPEKRLEWVA**SISRGGTTYYPDSVKG**RFTISRDNVRNILYLQMSSLRSEDTAMYYCGR**YDYDGYYAMDY**WGQGTSVTVSS | | | WFQQKPGKSPKTLIY**RANRLVD**GVPSRFSGGGSGQDYSLTINSLEYEDMGIYYC**LQYDEFPYT**FGGGTKLEMK | | |
| | | ROR1 | QSLEESGGRLVTPGTPLTLTCTVSGIDLN**SHWMS**WVRQAPGKGLEWIG**IIAASGSTYYANWAKG**RFTISKTSTTVDLRIASPTTEDTATYFCAR**DYGDYRLVTFNI**WGPGTLVTVSS | 8153 | 9151, 9152, 9153 | ELVMTQTPSSVSAAVGGTVTINC**QASQSIGSYLA**WYQQKPGQPPKLLIY**YASNLAS**GVPSRFSGSGSGTEYTLTISGVQREDAATYYCLG**SLSNSDNV**FGGGTELEIL | 8249 | 9374, 9375, 9376 |
| | | ROR1 | QSVKESEGDLVTPAGNLTLTCTASGSDIN**DYPIS**WVRQAPGKGLEWIG**FINSGGSTWYASWVKG**RFTISRTSTTVDLKMTSLTTDDTATYFCAR**GYSTYYCDFNI**WGPGTLVTISS | 8154 | 9154, 9155, 9156 | ELVMTQTPSSTSGAVGGTVTINC**QASQSIDSNLA**WFQQKPGQPPTLLIY**RASNLAS**GVPSRFSGSRSGTEYTLTISGVQREDAATYYC**LGGVGNVSYRTS**FGGGTEVVVK | 8250 | 9377, 9378, 9379 |
| CC49 (Humanized) | | TAG-72 | QVQLVQSGAEVVKPGASVKISCKASGYTFT**DHAIH**WVKQNPGQRLEWIG**YFSPGNDDFKYNERFKG**KATLTADTSASTAYVELSSLRSEDTAVYFCTR**SLNMAY**WGQGTLVTVSS | 8155 | 9157, 9158, 9013 | DIVMSQSPDSLAVSLGERVTLNCKSS**QSLLYSGNQKNYLA**WYQQKPGQSPKLLIY**WASARES**GVPDRFSGSGSGTDFTLTISSVQAEDVAVYYC**QQYYSYPLT**FGAGTKLELK | 8251 | 9380, 9381, 9262 |
| | Murine A1 | TPBG/5T4 | QIQLVQSGPELKKPGETVKISCKAS**GYTFTNFGMN**WVKQGPGEGLKWMG**WINTNTGEPRYAEEFKG**RXAFSLETTASTAYLQINNLKNEDTATYFCAR**DWDGAYFFDY**WGQGTTLTVSS | 8156 | 9159, 9160, 9161 | SIVMTQTPKFLLVSAGDRVTITC**KASQSVSNDVA**WYQQKPGQSPKLLIN**FATNRYT**GVPNRFTGSGYGTDFTFTISTVQAEDLALYFC**QQDYSSPWT**FGGGTKLEIK | 8252 | 9382, 9383, 9384 |
| | Murine A2 | TPBG/5T4 | QVQLQQSRPELVKPGASVKMSCKAS**GYTFTDYVIS**WVKQRTGQGLEWIG**EIYPGSNSIYYNEKFKG**RATLTADKSSSTAYMQLSSLTSEDSAVYFCAM**GGNYGFDY**WGQGTTLTVSS | 8157 | 9162, 9163, 9164 | SVIMSRGQIVLTQSPAIMSASLGERVTLTC**TASSVNSNYLH**WYQQKPGSSPKLWIY**STSNLAS**GVPARFSGSGSGTSYSLTISSMEAEDAATYYC**HQYHRSPLT**FGAGTKLELK | 8253 | 9385, 9348, 9386 |

TABLE 6f-continued

Anti-target Cell Monoclonal Antibodies and Sequences

| Trade Name | Antibody Name | Target | VH Sequence | SEQ ID NO: (full-length) | SEQ ID NO: (CDRs) | VL Sequence | SEQ ID NO: (full-length) | SEQ ID NO: (CDRs) |
|---|---|---|---|---|---|---|---|---|
| | Murine A3 | TPBG/5T4 | EVQLVESGGGLVQPKGSLKLSCAAS**GFTFNTYAMN**WVRQAPGKGLEWVA**RIRSKSNNYATYYADSVKD**RFTISRDDSQSMLYLQMNNLKTEDTAMYXCVR**QWDYDVRAMNY**WGQGTSVTVSS | 8158 | 742, 9165, 9166 | DIVMTQSHIFMSTSVGDRVSITC**KASQDVDTAVA**WYQQKPGQSPKLLIY**WASTRLT**GVPDRFTGSGSGTDFTLTISNVQSEDLADYFC**QQYSSYPYT**FGGGTKLEIK | 8254 | 9387, 9388, 9389 |
| IMMU-132 | hRS-7 | TROP-2 | QVQLQQSGSELKKPGASVKVSCKASGYTFT**NYGMN**WVKQAPGQGLKWMG**WINTYTGEPTYTDDFKG**RFAFSLDTSVSTAYLQISSLKADDTAVYFCAR**GGFGSSYWYFDV**WGQGSLVTVSS | 8159 | 9016, 9167, 9168 | DIQLTQSPSSLSASVGDRVSITC**KASQDVSIAVA**WYQQKPGKAPKLLIY**SASYRYT**GVPDRFSGSGSGTDFTLTISSLQPEDFAVYYC**QQHYITPLT**FGAGTKVEIK | 8255 | 9390, 9391, 9392 |
| IMC-18F1 | icrucumab | VEGFR1 | QAQVVESGGGVVQSGRSLRLSCAAS**GFAFSSYGMHW**VRQAPGKGLEWVA**VIWYDGSNKYYADSVRG**RFTISRDNSENTLYLQMNSLRAEDTAVYYCAR**DHYGSGVHHYFYYGLDV**WGQGTTVTVSS | 8160 | 9169, 9170, 9171 | EIVLTQSPGTLSLSPGERATLSC**RASQSVSSSYLA**WYQQKPGQAPRLLIY**GASSRAT**GIPDRFSGSGSGTDFTLTISRLEPEDFAVYYC**QQYGSSPLT**FGGGTKVEIK | 8256 | 9285, 9182, 9393 |
| Cyramza | ramucirumab | VEGFR2 | EVQLVQSGGGLVKPGGSLRLSCAAS**GFTFSSYSMN**WVRQAPGKGLEWVSSISSSS**SYIYYADSVKG**RFTISRDNAKNSLYLQMNSLRAEDTAVYYCAR**VTDAFDI**WGQGTMVTVSSA | 8161 | 9172, 9173, 9174 | DIQMTQSPSSVSASIGDRVTITC**RASQGIDN**WLGWYQQKPGKAPKLLIY**DASNLDT**GVPSRFSGSGSGTYFTLTISSLQAEDFAVYFC**QQAKAFPPT**FGGGTKVDIK | 8257 | 9394, 9395, 9396 |
| g165DFM-PEG | alacizumab pegol | VEGFR2 | EVQLVESGGGLVQPGGSLRLSCAAS**GFTFSSYGMS**WVRQAPGKGLEWVAT**ITSGGSYT**YYVDSVKGRFTISRDNAKNTLYLQMNSLRAEDTAVYYC**VRIGEDALDY**WGQGTLVTVSS | 8162 | 9175, 9176, 9177 | DIQMTQSPSSLSASVGDRVTITCRAS**QDIAGS**LNWLQQKPGKAIKRLIY**ATS**SLDSGVPKRFSGSRSGSDYTLTISSLQPEDFATYYC**LQYGSFPPT**FGQGTKVEIK | 8258 | 9397, 9212, 9398 |
| Imclone6.64 | | VEGFR2 | KVQLQQSGTELVKPGASVKVSCKASGYIFTEYIIHWVKQRSGQGLEWIGWLYPESNIIKYNEKFKDKATLTADKSSSTVYMELSRLTS | 8163 | | DIVLTQSPASLAVSLGQRATISCRASESVDSYGNSFMHWYQQKPGQPPKLLIYRASNLESGIPARFSGSGSRTDFTLTINPVEADDVATYY | 8259 | |

TABLE 6f-continued

Anti-target Cell Monoclonal Antibodies and Sequences

| Trade Name | Antibody Name | Target | VH Sequence | SEQ ID NO: (full-length) | SEQ ID NO: (CDRs) | VL Sequence | SEQ ID NO: (full-length) | SEQ ID NO: (CDRs) |
|---|---|---|---|---|---|---|---|---|
| | | | EDSAVYFCTRH DGTNFDYWGQ GTTLTVSSA | | | CQQSNEDPLTF GAGTKLELK | | |

*underlined & bolded sequences, if present, are CDRs within the VL and VH

Epithelial cell adhesion molecule (EpCAM, also known as 17-1A antigen) is a 40-kDa membrane-integrated glycoprotein composed of 314 amino acids expressed in certain epithelia and on many human carcinomas (see, Balzar, The biology of the 17-1A antigen (Ep-CAM), J. Mol. Med. 1999, 77:699-712). Because of their epithelial cell origin, tumor cells from most carcinomas express EpCAM on their surface (more so than normal, healthy cells), including the majority of primary, metastatic, and disseminated non-small cell lung carcinoma cells (Passlick, B., et al. The 17-1A antigen is expressed on primary, metastatic and disseminated non-small cell lung carcinoma cells. Int. J. Cancer 87(4):548-552, 2000), gastric and gastro-oesophageal junction adenocarcinomas (Martin, I. G., Expression of the 17-1A antigen in gastric and gastro-oesophageal junction adenocarcinomas: a potential immunotherapeutic target? J Clin Pathol 1999; 52:701-704), and breast and colorectal cancer (Packeisen J, et al. Detection of surface antigen 17-1A in breast and colorectal cancer. Hybridoma. 1999 18(1):37-40) in breast cancer, overexpression of EpCAM on tumor cells is a predictor of survival (Gastl, Lancet. 2000, 356, 1981-1982). Due to their epithelial cell origin, tumor cells from most carcinomas express EpCAM on their surface.

In one embodiment provided herein are bispecific chimeric polypeptide assembly compositions with a first portion having a binding domain specific for EpCAM and a binding domain specific for CD3. The technical problem to be solved was to provide means and methods for the generation of improved compositions exhibiting the properties of being well-tolerated and more convenient medicaments (less frequent dosing) for the effective treatment and or amelioration of tumorous diseases. The solution to said technical problem is achieved by the embodiments disclosed herein and characterized in the claims.

Accordingly, in some embodiments, the present invention relates to chimeric polypeptide assembly compositions whereby said composition comprises a first portion comprising a bispecific single chain antibody composition comprising at least two binding domains, whereby one of said domains binds to an effector cell antigen, such as CD3 antigen and a second domain binds to EpCAM antigen, wherein said binding domains comprise VL and VH specific for EpCAM and VL and VH specific for human CD3 antigen. Preferably, in the embodiment, said binding domain specific for EpCAM has a $K_d$ value of greater than $10^{-7}$ to $10^{-10}$ M, as determined in an in vitro binding assay. In one embodiment of the foregoing, the binding domains are in a scFv format. In another embodiment of the foregoing, the binding domains are in a single chain diabody format.

In some embodiments, the invention provides chimeric polypeptide assembly compositions comprising a first portion binding domain with binding affinity to a tumor-specific marker and a second binding domain binds to an effector cell antigen, such as CD3 antigen. Tumor-specific markers comprising these embodiments of the invention include but are not limited to CCR5, CD19, HER-2, HER-3, HER-4, EGFR, PSMA, CEA, MUC1, MUC2, MUC3, MUC4, MUC5AC, MUC5B, MUC7, βhCG, Lewis-Y, CD-20, CD33, CD30, ganglioside GD3, 9-O-Acetyl-GD3, Globo H, fucosyl GM1, GD-2, carbonic anhydrase IX, CD44v6, Sonic Hedgehog, Wue-1, plasma cell antigen 1, melanoma chondroitin sulfate proteoglycan, CCR8, 6-transmembrane epithelial antigen of prostate (STEAP), mesothelin, A33 antigen, prostate stem cell antigen (PSCA), LY-6, SAS, desmoglein 4, fetal acetylcholine receptor, CD-25, cancer antigen 19-9 (CA 19-9), cancer antigen 125 (CA-125), Muellerian inhibitory substance type II receptor (MISIIR), sialylated Tn antigen, fibroblast activation antigen (FAP), endosialin (CD248), epidermal growth factor receptor variant III (EGFRvIII), tumor-associated antigen L6 (TAL6), CD-63, TAG-72, Thomsen-Friedenreich antigen (TF-antigen), insulin-like growth factor I receptor (IGF-IR), Cora antigen, CD7, CD22, CD79a, CD79b, G250, F19, EphA2, and MT-MM. In certain embodiments, the invention provides a chimeric polypeptide assembly composition comprising a first portion binding domain with binding affinity to the tumor-specific marker comprising anti-marker VL and VH sequences. Exemplary, non-limiting examples of VL and VH sequences specific for certain of these tumor markers are set forth in Table 6f. In other embodiments, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an in vitro binding assay.

It is specifically contemplated that the chimeric polypeptide assembly composition can comprise any one of the foregoing binding domains or sequence variants thereof so long as the variants exhibit binding specificity for the described antigen. In one embodiment, a sequence variant would be created by substitution of an amino acid in the VL or VH sequence with a different amino acid. In deletion variants, one or more amino acid residues in a VL or VH sequence as described herein are removed. Deletion variants, therefore, include all fragments of a binding domain polypeptide sequence. In substitution variants, one or more amino acid residues of a VL or VH (or CDR) polypeptide are removed and replaced with alternative residues. In one aspect, the substitutions are conservative in nature and conservative substitutions of this type are well known in the art. In addition, it is specifically contemplated that the compositions comprising the first and the second binding domains disclosed herein can be utilized in any of the methods disclosed herein.

Unstructured Conformation

Typically, the XTEN polypeptide component of the fusion proteins disclosed herein are designed to behave like denatured peptide sequences under physiological conditions, despite the extended length of the polymer. "Denatured" describes the state of a peptide in solution that is characterized by a large conformational freedom of the peptide backbone. Most peptides and proteins adopt a denatured conformation in the presence of high concentrations of denaturants or at elevated temperature. Peptides in denatured conformation have, for example, characteristic circular dichroism (CD) spectra and are characterized by a lack of long-range interactions as determined by NMR. "Denatured conformation" and "unstructured conformation" are used synonymously herein. In some cases, the invention provides XTEN polypeptides that, under physiologic conditions, can resemble denatured sequences largely devoid in secondary structure. In other cases, the XTEN polypeptides can be substantially devoid of secondary structure under physiologic conditions. "Largely devoid," as used in this context, means that less than 50% of the XTEN amino acid residues of each XTEN polypeptide contribute to secondary structure as measured or determined by the means described herein. "Substantially devoid," as used in this context, means that at least about 60%, or about 70%, or about 80%, or about 90%, or about 95%, or at least about 99% of the XTEN amino acid residues of the XTEN sequence do not contribute to secondary structure, as measured or determined by the means described herein.

A variety of methods have been established in the art to discern the presence or absence of secondary and tertiary structures in a given polypeptide. In particular, XTEN secondary structure can be measured spectrophotometrically, e.g., by circular dichroism spectroscopy in the "far-UV" spectral region (190-250 nm). Secondary structure elements, such as alpha-helix and beta-sheet, each give rise to a characteristic shape and magnitude of CD spectra. Secondary structure can also be predicted for a polypeptide sequence via certain computer programs or algorithms, such as the well-known Chou-Fasman algorithm (Chou, P. Y., et al. (1974) Biochemistry, 13: 222-45) and the Garnier-Osguthorpe-Robson ("GOR") algorithm (Gamier J, Gibrat J F, Robson B. (1996), GOR method for predicting protein secondary structure from amino acid sequence. Methods Enzymol 266:540-553), as described in US Patent Application Publication No. 20030228309A1. For a given sequence, the algorithms can predict whether there exists some or no secondary structure at all, expressed as the total and/or percentage of residues of the sequence that form, for example, alpha-helices or beta-sheets or the percentage of residues of the sequence predicted to result in random coil formation (which lacks secondary structure).

In some cases, the XTEN polypeptides used in the inventive fusion protein compositions can have an alpha-helix percentage ranging from 0% to less than about 5% as determined by a Chou-Fasman algorithm. In other cases, the XTEN polypeptides comprising the fusion protein compositions can have a beta-sheet percentage ranging from 0% to less than about 5% as determined by a Chou-Fasman algorithm. In some cases, the XTEN sequences of the fusion protein compositions can have an alpha-helix percentage ranging from 0% to less than about 5% and a beta-sheet percentage ranging from 0% to less than about 5% as determined by a Chou-Fasman algorithm. In preferred embodiments, the XTEN polypeptides comprising the fusion protein compositions can have an alpha-helix percentage less than about 2% and a beta-sheet percentage less than about 2%. In other cases, the XTEN sequences of the fusion protein compositions can have a high degree of random coil percentage, as determined by a GOR algorithm. In some embodiments, an XTEN polypeptide can have at least about 80%, more preferably at least about 90%, more preferably at least about 91%, more preferably at least about 92%, more preferably at least about 93%, more preferably at least about 94%, more preferably at least about 95%, more preferably at least about 96%, more preferably at least about 97%, more preferably at least about 98%, and most preferably at least about 99% random coil, as determined by a GOR algorithm.

Net Charge

In other cases, the XTEN polypeptides can have an unstructured characteristic imparted by incorporation of amino acid residues with a net charge and/or reducing the proportion of hydrophobic amino acids in the XTEN polypeptide. The overall net charge and net charge density can be controlled by modifying the content of charged amino acids in the XTEN polypeptides. In some cases, the net charge density of the XTEN of the compositions can be above +0.1 or below −0.1 charges/residue. In other cases, the net charge of a XTEN polypeptide can be about 0%, about 1%, about 2%, about 3%, about 4%, about 5%, about 6%, about 7%, about 8%, about 9%, about 10% about 11%, about 12%, about 13%, about 14%, about 15%, about 16%, about 17%, about 18%, about 19%, or about 20% or more.

Because most tissues and surfaces in a human or animal have a net negative charge, the XTEN polypeptides can be designed to have a net negative charge to minimize non-specific interactions between the XTEN polypeptide-containing compositions and various surfaces such as blood vessels, healthy tissues, or various receptors. Not to be bound by a particular theory, the XTEN polypeptide can adopt open conformations due to electrostatic repulsion between individual amino acids of the XTEN polypeptide that individually carry a high net negative charge and that are distributed across the sequence of the XTEN polypeptide. Such a distribution of net negative charge in the extended sequence lengths of XTEN polypeptide can lead to an unstructured conformation that, in turn, can result in an effective increase in hydrodynamic radius. Accordingly, in one embodiment the invention provides XTEN polypeptides in which the XTEN polypeptides contain about 8, 10, 15, 20, 25, or even about 30% glutamic acid. The XTEN polypeptides of the compositions of the present invention generally have no or a low content of positively charged amino acids. In some cases the XTEN polypeptides can have less than about 10% amino acid residues with a positive charge, or less than about 7%, or less than about 5%, or less than about 2% amino acid residues with a positive charge. However, the invention contemplates constructs where a limited number of amino acids with a positive charge, such as lysine, can be incorporated into XTEN polypeptides to permit conjugation between the epsilon amine of the lysine and a reactive group on a peptide, a linker bridge, or a reactive group on a drug or small molecule to be conjugated to the XTEN polypeptide backbone. In the foregoing, a fusion proteins can be constructed that comprises one or more XTEN polypeptides, a biologically active protein, plus a chemotherapeutic agent useful in the treatment of metabolic diseases or disorders, wherein the maximum number of molecules of the agent incorporated into the XTEN polypeptide component is determined by the numbers of lysines or other amino acids with reactive side chains (e.g., cysteine) incorporated into the XTEN.

In some cases, an XTEN polypeptide can comprise charged residues separated by other residues such as serine or glycine, which can lead to better expression or purification behavior. Based on the net charge, XTEN polypeptides of the human or animal compositions can have an isoelectric point (pI) of 1.0, 1.5, 2.0, 2.5, 3.0, 3.5, 4.0, 4.5, 5.0, 5.5, 6.0, or even 6.5. In preferred embodiments, the XTEN polypeptide has an isoelectric point between 1.5 and 4.5. In these embodiments, the XTEN incorporated into the BPXTEN fusion protein compositions of the present invention would carry a net negative charge under physiologic conditions that can contribute to the unstructured conformation and reduced binding of the XTEN polypeptide component to mammalian proteins and tissues.

As hydrophobic amino acids can impart structure to a polypeptide, the invention provides that the content of hydrophobic amino acids in the XTEN polypeptides typically is less than 5%, or less than 2%, or less than 1% hydrophobic amino acid content. In one embodiment, the amino acid content of methionine and tryptophan in the XTEN component of a BPXTEN fusion protein is typically less than 5%, or less than 2%, and most preferably less than 1%. In another embodiment, the XTEN polypeptide has a sequence that has less than 10% amino acid residues with a positive charge, or less than about 7%, or less that about 5%, or less than about 2% amino acid residues with a positive charge, the sum of methionine and tryptophan residues is less than 2%, and the sum of asparagine and glutamine residues is less than 10% of the total XTEN polypeptide.

Increased Hydrodynamic Radius

In some embodiments, the XTEN polypeptide can have a high hydrodynamic radius, conferring a corresponding increased Apparent Molecular Weight to the BPXTEN fusion protein which incorporates the XTEN polypeptide. The linking of an XTEN polypeptide to BP sequences can result in BPXTEN compositions that can have increased hydrodynamic radii, increased Apparent Molecular Weight, and increased Apparent Molecular Weight Factor compared to a BP not linked to an XTEN polypeptide. For example, in therapeutic applications in which prolonged half-life is desired, compositions in which a XTEN polypeptide with a high hydrodynamic radius is incorporated into a fusion protein comprising one or more BP can effectively enlarge the hydrodynamic radius of the composition beyond the glomerular pore size of approximately 3-5 nm (corresponding to an apparent molecular weight of about 70 kDA) (Caliceti. 2003. Pharmacokinetic and biodistribution properties of poly(ethylene glycol)-protein conjugates. Adv. Drug Deliv. Rev. 55:1261-1277), resulting in reduced renal clearance of circulating proteins. Not to be bound by a particular theory, an XTEN polypeptide can adopt open conformations due to electrostatic repulsion between individual charges of the peptide or the inherent flexibility imparted by the particular amino acids in the sequence that lack potential to confer secondary structure. The open, extended and unstructured conformation of the XTEN polypeptide can have a greater proportional hydrodynamic radius compared to polypeptides of a comparable sequence length and/or molecular weight that have secondary and/or tertiary structure, such as typical globular proteins. Methods for determining the hydrodynamic radius are well known in the art, such as by the use of size exclusion chromatography (SEC), as described in U.S. Pat. Nos. 6,406,632 and 7,294,513. The addition of increasing lengths of XTEN polypeptides results in proportional increases in the parameters of hydrodynamic radius, Apparent Molecular Weight, and Apparent Molecular Weight Factor, permitting the tailoring of BPXTEN to desired characteristic cut-off Apparent Molecular Weights or hydrodynamic radii. Accordingly, in certain embodiments, the BPXTEN fusion protein can be configured with an XTEN polypeptide, wherein the fusion protein can have a hydrodynamic radius of at least about 5 nm, or at least about 8 nm, or at least about 10 nm, or 12 nm, or at least about 15 nm. In the foregoing embodiments, the large hydrodynamic radius conferred by XTEN polypeptides in an BPXTEN fusion protein can lead to reduced renal clearance of the resulting fusion protein, leading to a corresponding increase in terminal half-life, an increase in mean residence time, and/or a decrease in renal clearance rate.

In another embodiment, an XTEN polypeptide of a chosen length and sequence can be selectively incorporated into a BPXTEN to create a fusion protein that has, under physiologic conditions, an Apparent Molecular Weight of at least about 150 kDa, or at least about 300 kDa, or at least about 400 kDa, or at least about 500 kDA, or at least about 600 kDa, or at least about 700 kDA, or at least about 800 kDa, or at least about 900 kDa, or at least about 1000 kDa, or at least about 1200 kDa, or at least about 1500 kDa, or at least about 1800 kDa, or at least about 2000 kDa, or at least about 2300 kDa or more. In another embodiment, an XTEN polypeptide of a chosen length and sequence can be selectively linked to a BP to result in a BPXTEN fusion protein that has, under physiologic conditions, an Apparent Molecular Weight Factor of at least three, alternatively of at least four, alternatively of at least five, alternatively of at least six, alternatively of at least eight, alternatively of at least 10, alternatively of at least 15, or an Apparent Molecular Weight Factor of at least 20 or greater. In another embodiment, the BPXTEN fusion protein has, under physiologic conditions, an Apparent Molecular Weight Factor that is about 4 to about 20, or is about 6 to about 15, or is about 8 to about 12, or is about 9 to about 10 relative to the actual molecular weight of the fusion protein. In some embodiments, the (fusion) polypeptide exhibits an apparent molecular weight factor under physiological conditions that is greater than about 6.

Increased Terminal Half-Life

In some embodiments, the (fusion) polypeptide has a terminal half-life that is at least two-fold longer, or at least three-fold longer, or at least four-fold longer, or at least five-fold longer, compared to the biologically active polypeptide not linked to an XTEN polypeptide. In some embodiments, the (fusion) polypeptide has a terminal half-life that is at least two-fold longer compared to the biologically active polypeptide not linked to an XTEN polypeptide.

Administration of a therapeutically effective dose of any of the embodiments of BPXTEN fusion proteins described herein to a human or animal in need thereof can result in a gain in time of at least two-fold, or at least three-fold, or at least four-fold, or at least five-fold or more spent within a therapeutic window for the fusion protein compared to the corresponding BP not linked to the XTEN polypeptide of and administered at a comparable dose to a human or animal.

Low Immunogenicity

In another aspect, the invention provides compositions in which the XTEN polypeptides have a low degree of immunogenicity or are substantially non-immunogenic. Several factors can contribute to the low immunogenicity of XTEN polypeptides, e.g., the substantially non-repetitive sequence, the unstructured conformation thereof, the high degree of solubility, the low degree or lack of self-aggregation, the low degree or lack of proteolytic sites within the sequence, and the low degree or lack of epitopes in XTEN polypeptides.

One of ordinary skill in the art will understand that, in general, a polypeptide having highly repetitive short amino acid sequences (e.g., wherein a 200 amino acid-long sequence contain on average 20 repeats or more of a limited set of 3- or 4-mers) and/or having contiguous repetitive amino acid residues (e.g., wherein 5- or 6-mer sequences have identical amino acid residues) have a tendency to aggregate or form higher order structures or form contacts resulting in crystalline or pseudo-crystalline structures.

In some embodiments, XTEN polypeptides are substantially non-repetitive, wherein the XTEN amino acid sequence has no three contiguous amino acids that are identical amino acid types, unless the amino acid is serine, in which case no more than three contiguous amino acids can be serine residues; and wherein the XTEN amino acid sequence contains no 3-amino acid sequences (3-mers) that occur more than 16, more than 14, more than 12, or more than 10 times within a 200 amino acid-long sequence of the XTEN polypeptide. One of ordinary skill in the art will understand that such substantially non-repetitive sequences have less tendency to aggregate and, thus, enable the design of long-sequence XTENs with a relatively low frequency of charged amino acids that would be likely to aggregate if the sequences or amino acid residues were otherwise more repetitive.

Conformational epitopes are formed by regions of the protein surface that are composed of multiple discontinuous amino acid sequences of the protein antigen. The precise folding of the protein brings these sequences into a well-defined, stable spatial configurations, or epitopes, that can be recognized as “foreign” by the host humoral immune system, resulting in the production of antibodies to the protein or triggering a cell-mediated immune response. In the latter case, the immune response to a protein in an individual is heavily influenced by T-cell epitope recognition that is a function of the peptide binding specificity of that individual’s HLA-DR allotype. Engagement of an MHC Class II peptide complex by a cognate T-cell receptor on the surface of the T-cell, together with the cross-binding of certain other co-receptors such as the CD4 molecule, can induce an activated state within the T-cell. Activation leads to the release of cytokines further activating other lymphocytes such as B cells to produce antibodies or activating T killer cells as a full cellular immune response.

The ability of a peptide to bind a given MHC Class II molecule for presentation on the surface of an APC (antigen presenting cell) is dependent on a number of factors; most notably its primary sequence. In one embodiment, a lower degree of immunogenicity can be achieved by designing XTEN polypeptides that resist antigen processing in antigen presenting cells, and/or choosing sequences that do not bind MHC receptors well. The invention provides BPXTEN fusion proteins with substantially non-repetitive XTEN polypeptides designed to reduce binding with MHC II receptors, as well as avoiding formation of epitopes for T-cell receptor or antibody binding, resulting in a low degree of immunogenicity. Avoidance of immunogenicity is, in part, a direct result of the conformational flexibility of XTEN polypeptides; i.e., the lack of secondary structure due to the selection and order of amino acid residues. For example, of particular interest are sequences having a low tendency to adapt compactly folded conformations in aqueous solution or under physiologic conditions that could result in conformational epitopes. The administration of fusion proteins comprising XTEN polypeptides(s), using conventional therapeutic practices and dosing, would generally not result in the formation of neutralizing antibodies to the XTEN polypeptide, and can also reduce the immunogenicity of the BP fusion partner in the BPXTEN compositions.

In one embodiment, the XTEN polypeptides utilized in the human or animal fusion proteins can be substantially free of epitopes recognized by human T cells. The elimination of such epitopes for the purpose of generating less immunogenic proteins has been disclosed previously; see for example WO 98/52976, WO 02/079232, and WO 00/3317 which are incorporated by reference herein. Assays for human T cell epitopes have been described (Stickler, M., et al. (2003) *J Immunol Methods,* 281: 95-108). Of particular interest are peptide sequences that can be oligomerized without generating T cell epitopes or non-human sequences. This can be achieved by testing direct repeats of these sequences for the presence of T-cell epitopes and for the occurrence of 6 to 15-mer and, in particular, 9-mer sequences that are not human, and then altering the design of the XTEN polypeptide to eliminate or disrupt the epitope sequence. In some cases, the XTEN polypeptides are substantially non-immunogenic by the restriction of the numbers of epitopes of the XTEN polypeptide predicted to bind MHC receptors. With a reduction in the numbers of epitopes capable of binding to MHC receptors, there is a concomitant reduction in the potential for T cell activation as well as T cell helper function, reduced B cell activation or upregulation and reduced antibody production. The low degree of predicted T-cell epitopes can be determined by epitope prediction algorithms such as, e.g., TEPITOPE (Sturniolo, T., et al. (1999) Nat Biotechnol, 17: 555-61), as shown in Example 74 of International Patent Application Publication No. WO 2010/144502 A2, which is incorporated by reference in its entirety. The TEPITOPE score of a given peptide frame within a protein is the log of the $K_d$ (dissociation constant, affinity, off-rate) of the binding of that peptide frame to multiple of the most common human MHC alleles, as disclosed in Sturniolo, T. et al. (1999) Nature Biotechnology 17:555). The score ranges over at least 20 logs, from about 10 to about −10 (corresponding to binding constraints of $10e^{10}$ $K_d$ to $10e^{-10}$ $K_d$), and can be reduced by avoiding hydrophobic amino acids that can serve as anchor residues during peptide display on MHC, such as M, I, L, V, F. In some embodiments, an XTEN polypeptide incorporated into a BPXTEN does not have a predicted T-cell epitope at a TEPITOPE score of about −5 or greater, or -6 or greater, or -7 or greater, or -8 or greater, or at a TEPITOPE score of −9 or greater. As used herein, a score of “−9 or greater” would encompass TEPITOPE scores of 10 to −9, inclusive, but would not encompass a score of −10, as −10 is less than −9.

In another embodiment, the inventive XTEN polypeptides, including those incorporated into the human or animal BPXTEN fusion proteins, can be rendered substantially non-immunogenic by the restriction of known proteolytic sites from the sequence of the XTEN polypeptide, reducing the processing of XTEN polypeptides into small peptides that can bind to MHC II receptors. In another embodiment, the XTEN polypeptide can be rendered substantially non-immunogenic by the use a sequence that is substantially devoid of secondary structure, conferring resistance to many proteases due to the high entropy of the structure. Accordingly, the reduced TEPITOPE score and elimination of known proteolytic sites from the XTEN polypeptides can render the XTEN-polypeptide compositions, including the XTEN polypeptides of the BPXTEN fusion protein compositions, substantially unable to be bound by mammalian receptors, including those of the immune system. In one embodiment, an XTEN polypeptide of a BPXTEN fusion protein can have >100 nM $K_d$ binding to a mammalian receptor, or greater than 500 nM $K_d$, or greater than 1 μM $K_d$ towards a mammalian cell surface or circulating polypeptide receptor.

Additionally, the substantially non-repetitive sequence and corresponding lack of epitopes of such embodiments of XTEN polypeptides can limit the ability of B cells to bind to or be activated by XTEN polypeptides. While an XTEN polypeptide can make contacts with many different B cells over its extended sequence, each individual B cell can only make one or a small number of contacts with an individual XTEN polypeptide. As a result, XTEN polypeptides typically can have a much lower tendency to stimulate proliferation of B cells and thus an immune response. In one embodiment, the BPXTEN can have reduced immunogenicity as compared to the corresponding BP that is not fused. In one embodiment, the administration of up to three parenteral doses of a BPXTEN to a mammal can result in detectable anti-BPXTEN IgG at a serum dilution of 1:100 but not at a dilution of 1:1000. In another embodiment, the administration of up to three parenteral doses of an BPXTEN to a mammal can result in detectable anti-BP IgG at a serum dilution of 1:100 but not at a dilution of 1:1000. In another embodiment, the administration of up to three parenteral doses of an BPXTEN to a mammal can result in detectable anti-XTEN IgG at a serum dilution of 1:100 but not at a dilution of 1:1000. In the foregoing embodiments, the mammal can be a mouse, a rat, a rabbit, or a cynomolgus monkey.

An additional feature of certain embodiments of XTEN polypeptides with substantially non-repetitive sequences relative to those less non-repetitive sequences (such as one having three contiguous amino acids that are identical) can be that non-repetitive XTEN polypeptides form weaker contacts with antibodies (e.g. monovalent interactions), thereby resulting in less likelihood of immune clearance wherein the BPXTEN compositions can remain in circulation for an increased period of time.

In some embodiments, the (fusion) polypeptide is less immunogenic compared to the biologically active polypeptide not linked to an XTEN polypeptide, wherein immunogenicity is ascertained by measuring production of IgG antibodies that selectively bind to the biologically active polypeptide after administration of comparable doses to a human or animal.

Spacers & BP Release Segment

In some embodiments, at least a portion of the biological activity of the respective BP is retained by the intact BPXTEN. In some embodiments, the BP component either becomes biologically active or has an increase in biological activity upon its release from the XTEN polypeptide(s) by cleavage of an optional cleavage sequence incorporated within spacer sequences into the BPXTEN, as described more fully hereinbelow.

Any spacer sequence group is optional in the fusion proteins encompassed by the invention. The spacer can be provided to enhance expression of the fusion protein from a host cell or to decrease steric hindrance wherein the BP component can assume its desired tertiary structure and/or interact appropriately with its target molecule. For spacers and methods of identifying desirable spacers, see, for example, George, et al. (2003) Protein Engineering 15:871-879, specifically incorporated by reference herein. In one embodiment, the spacer comprises one or more peptide sequences that are between 1 to 50 amino acid residues in length, or about 1 to 25 residues, or about 1 to 10 residues in length. Spacer sequences, exclusive of cleavage sites, can comprise any of the 20 natural L amino acids, and preferably comprises hydrophilic amino acids that are sterically unhindered that can include, but not be limited to, glycine (G), alanine (A), serine (S), threonine (T), glutamate (E) and proline (P). In some embodiments, the spacer can be polyglycines or polyalanines, or predominately a mixture of combinations of glycine and alanine residues. The spacer polypeptide exclusive of a cleavage sequence is largely to substantially devoid of secondary structure. In one embodiment, one or both spacer sequences in a BPXTEN fusion protein composition can each further contain a cleavage sequence, which can be identical or can be different, wherein the cleavage sequence can be acted on by a protease to release the BP from the fusion protein.

In some cases, the incorporation of the cleavage sequence into the BPXTEN is designed to permit release of a BP that becomes active or more active upon its release from the XTEN polypeptide. The cleavage sequences are located sufficiently close to the BP sequences, generally within 18, or within 12, or within 6, or within 2 amino acids of the BP sequence terminus, wherein any remaining residues attached to the BP after cleavage do not appreciably interfere with the activity (e.g., such as binding to a receptor) of the BP, yet provide sufficient access to the protease to be able to effect cleavage of the cleavage sequence. In some embodiments, the cleavage site is a sequence that can be cleaved by a protease endogenous to the mammalian human or animal wherein the BPXTEN can be cleaved after administration to a human or animal. In such cases, the BPXTEN can serve as a prodrug or a circulating depot for the BP. Examples of cleavage sites contemplated by the invention include, but are not limited to, a polypeptide sequence cleavable by a mammalian endogenous protease selected from FXIa, FXIIa, kallikrein, FVIIa, FIXa, FXa, FIIa (thrombin), Elastase-2, granzyme B, MMP-12, MMP-13, MMP-17 or MMP-20, or by non-mammalian proteases such as TEV, enterokinase, PreScission™ protease (rhinovirus 3C protease), and sortase A. Sequences known to be cleaved by the foregoing proteases are known in the art. Exemplary cleavage sequences and cleavage sites within the sequences are set forth in Table 7a, as well as sequence variants. For example, thrombin (activated clotting factor II) acts on the sequence LTPRSLLV (SEQ ID NO: 222) {Rawlings N. D., et al. (2008) *Nucleic Acids Res.,* 36: D320}, which would be cleaved after the arginine at position 4 in the sequence. Active FIIa is produced by cleavage of FII by FXa in the presence of phospholipids and calcium and is downstream from factor IX in the coagulation pathway. Once activated its natural role in coagulation is to cleave fibrinogen, which then in turn, begins clot formation. FIIa activity is tightly controlled and only occurs when coagulation is necessary for proper hemostasis. However, as coagulation is an ongoing process in mammals, by incorporation of the LTPRSLLV (SEQ ID NO: 223) sequence into the BPXTEN between the BP and the XTEN polypeptide, the XTEN polypeptides would be removed from the adjoining BP concurrent with activation of either the extrinsic or intrinsic coagulation pathways when coagulation is required physiologically, thereby releasing BP over time. Similarly, incorporation of other sequences into BPXTEN that are acted upon by endogenous proteases would provide for sustained release of BP that can, in certain cases, provide a higher degree of activity for the BP from the "prodrug" form of the BPXTEN.

In some cases, only the two or three amino acids flanking both sides of the cleavage site (four to six amino acids total) would be incorporated into the cleavage sequence. In other cases, the known cleavage sequence can have one or more deletions or insertions or one or two or three amino acid substitutions for any one or two or three amino acids in the known sequence, wherein the deletions, insertions or substitutions result in reduced or enhanced susceptibility but not an absence of susceptibility to the protease, resulting in an ability to tailor the rate of release of the BP from the XTEN. Exemplary substitutions are shown in Table 7a.

TABLE 7a

Protease Cleavage Sequences for BP Release

| Protease Acting Upon Sequence | SEQ ID NO | Exemplary Cleavage Sequence | Minimal Cleavage Site* |
|---|---|---|---|
| FXIa | 224 | KLTR↓VVGG | KD/FL/T/R↓VA/VE/GT/GV |
| FXIIa | 225 | TMTR↓IVGG | NA |
| Kallikrein | 226 | SPFR↓STGG | -/-/FL/RY↓SR/RT/-/- |
| FVIIa | 227 | LQVR↓IVGG | NA |
| FIXa | 228 | PLGR↓IVGG | -/-/G/R↓-/-/-/- |
| FXa | 229 | IEGR↓TVGG | IA/E/GFP/R↓STI/VFS/-/G |
| FIIa (thrombin) | 230 | LTPR↓SLLV | -/-/PLA/R↓SAG/-/-/- |
| Elastase-2 | 231 | LGPV↓SGVP | -/-/VIAT↓-/-/-/- |
| Granzyme-B | 232 | VAGD↓SLEE | V/-/-/D↓-/-/-/- |
| MMP-12 | 233 | GPAG↓LGGA | G/PA/-/G↓L/-/G/- (SEQ ID NO: 241) |
| MMP-13 | 234 | GPAG↓LRGA | G/P/-/G↓L/-/GA/- (SEQ ID NO: 242) |
| MMP-17 | 235 | APLG↓LRLR | -/PS/-/-↓LQ/-/LT/- |
| MMP-20 | 236 | PALP↓LVAQ | NA |
| TEV | 237 | ENLYFQ↓VG | ENLYFQ↓G/S (SEQ ID NO: 243) |
| Enterokinase | 238 | DDDK↓IVGG | DDDK↓IVGG (SEQ ID NO: 244) |
| Protease 3C (PreScission ™) | 239 | LEVLFQ↓GP | LEVLFQ↓GP (SEQ ID NO: 245) |
| Sortase A | 240 | LPKT↓GSES | L/P/KEAD/T↓G/-/EKS/S (SEQ ID NO: 246) |

indicates cleavage site;
NA: not applicable;
*the listing of multiple amino acids before, between, or after a slash indicate alternative amino acids that can be substituted at the position;
"-" indicates that any amino acid can be substituted for the corresponding amino acid indicated in the middle column In some embodiments, the BPXTEN fusion protein can comprise spacer sequences that can further comprise one or more cleavage sequences configured to release the BP from the fusion protein when acted on by a protease. In some embodiments, the one or more cleavage sequences can be a sequence having at least about 80% (e.g., at least about 85%, at least about 90%, at least about 95%, at least about 96%, at least about 97%, at least about 98%, at least about 99%, or 100%) sequence identity to a sequence set forth in Table 7a.

In some embodiments, the disclosure provides BP release segment peptides (or release segment (RS)) that are substrates for one or more mammalian proteases associated with or produced by disease tissues or cells found in proximity to disease tissues. Such proteases can include, but not be limited to the classes of proteases such as metalloproteinases, cysteine proteases, aspartate proteases, and serine proteases, including, but not limited to, the proteases set forth in Table 7b. The RS are useful for, amongst other things, incorporation into the human or animal recombinant polypeptides, conferring a prodrug format that can be activated by the cleavage of the RS by mammalian proteases. As described herein, the RS are incorporated into the human or animal recombinant polypeptide compositions, linking the incorporated binding moieties to the XTEN (the configurations of which are described more fully, below) wherein upon cleavage of the RS by action of the one or more proteases for which the RS are substrates, the binding moieties and XTEN are released from the composition and the binding moieties, no longer shielded by the XTEN, regain their full potential to bind their ligands. In those recombinant polypeptide compositions comprising a first and a second antibody fragment, the compositions are also referred to herein as activatable antibody compositions (AAC).

TABLE 7b

| Proteases of Target Tissues | |
|---|---|
| Class of Proteases | Protease |
| Metalloproteinases | Meprin |
| | Neprilysin (CD10) |
| | PSMA |
| | BMP-1 |
| | A disintegrin and metalloproteinases (ADAMs) |
| | ADAM8 |
| | ADAM9 |
| | ADAM10 |
| | ADAM12 |
| | ADAM15 |
| | ADAM17 (TACE) |
| | ADAM19 |
| | ADAM28 (MDC-L) |
| | ADAM with thrombospondin motifs (ADAMTS) |
| | ADAMTS1 |
| | ADAMTS4 |
| | ADAMTS5 |
| | Matrix Metalloproteinases (MMPs) |
| | MMP-1 (Collagenase 1) |
| | MMP-2 (Gelatinase A) |
| | MMP-3 (m1) |
| | MMP-7 (Matrilysin 1) |
| | MMP-8 (Collagenase 2) |
| | MMP-9 (Gelatinase B) |
| | MMP-10 (Stromelysin 2) |
| | MMP-11(Stromelysin 3) |
| | MMP-12 (Macrophage elastase) |
| | MMP-13 (Collagenase 3) |
| | MMP-14 (MT1-MMP) |
| | MMP-15 (MT2-MMP) |
| | MMP-19 |
| | MMP-23 (CA-MMP) |
| | MMP-24 (MT5-MMP) |
| | MMP-26 (Matrilysin 2 |
| | MMP-27 (CMMP) |
| Cysteine Proteases | Legumain |
| | Cysteine cathepsins |
| | Cathepsin B |
| | Cathepsin C |
| | Cathepsin K |
| | Cathepsin L |
| | Cathepsin S |
| | Cathespin X |
| Aspartate Proteases | Cathepsin D |
| | Cathepsin E |
| | Secretase |
| Serine Proteases | Urokinase (uPA) |
| | Tissue-type plasminogen activator (tPA) |
| | Plasmin |
| | Thrombin |
| | Prostate-specific antigen (PSA, KLK3) |
| | Human neutrophil elastase (HNE) |
| | Elastase |
| | Tryptase |
| | Type II transmembrane serine proteases (TTSPs) |
| | DESC1 |
| | Hepsin (HPN) |
| | Matriptase |
| | Matriptase-2 |
| | TMPRSS2 |
| | TMPRSS3 |
| | TMPRSS4 (CAP2) |
| | Fibroblast Activation Protein (FAP) |
| | kallikrein-related peptidase (KLK family) |
| | KLK4 |
| | KLK5 |
| | KLK6 |
| | KLK7 |
| | KLK8 |
| | KLK10 |
| | KLK11 |

TABLE 7b-continued

| Proteases of Target Tissues | |
|---|---|
| Class of Proteases | Protease |
| | KLK13 |
| | KLK14 |

In one embodiment, the disclosure provides activatable recombinant polypeptides comprising a first release segment (RS1) sequence having at least 88%, or at least 94%, or 100% sequence identity, when optimally aligned, to a sequence selected from the sequences set forth in Table 8a, wherein the RS1 is a substrate for one or more mammalian proteases. In other embodiments, the disclosure provides activatable recombinant polypeptides comprising a RS1 and a second release segment (RS2) sequence, each having at least 88%, or at least 94%, or 100% sequence identity, when optimally aligned, to a sequence selected from the sequences set forth in Table 8a, wherein the RS1 and the RS2 each are a substrate for one or more mammalian proteases. In another embodiment, disclosure provides activatable recombinant polypeptides comprising a first RS (RS1) sequence having at least 90%, at least 93%, at least 97%, or 100% identity, when optimally aligned, to a sequence selected from the sequences set forth in Table 8b, wherein the RS is a substrate for one or more mammalian proteases. In other embodiments, the disclosure provides activatable recombinant polypeptides comprising a RS1 and a second release segment (RS2) sequence, each having at least 88%, or at least 94%, or 100% sequence identity, when optimally aligned, to a sequence selected from the sequences set forth in Table 8b, wherein the RS1 and the RS2 are each a substrate for one or more mammalian proteases. In the embodiments of activatable recombinant polypeptides comprising RS1 and RS2, the two release segments can be identical or the sequences can be different.

The present disclosure contemplates release segments that are substrates for one, two or three different classes of proteases selected from metalloproteinases, cysteine proteases, aspartate proteases, and serine proteases, including the proteases set forth in Table 7b. In a particular feature, the RS serve as substrates for proteases found in close association with or are co-localized with disease tissues or cells, such as but not limited to tumors, cancer cells, and inflammatory tissues, and upon cleavage of the RS, the binding moieties that are otherwise shielded by the XTEN of the human or animal recombinant polypeptide compositions (and thus have a lower binding affinity for their respective ligands) are released from the composition and regain their full potential to bind the target and/or effector cell ligands. In another embodiment, the RS of the human or animal recombinant polypeptide compositions comprises an amino acid sequence that is a substrate for a cellular protease located within a targeted cell, including but not limited to the proteases set forth in Table 7b. In another particular feature of the human or animal recombinant polypeptide compositions, the RS that are substrates for two or three classes of proteases were designed with sequences that are capable of being cleaved in different locations of the RS sequence by the different proteases. Thus, the RS that are substrates for two, three, or more classes of proteases have two, three, or a plurality of distinct cleavage sites in the RS sequence, but cleavage by a single protease nevertheless results in the release of the binding moieties and the XTEN from the recombinant polypeptide composition comprising the RS.

In one embodiment, the RS of the disclosure for incorporation into the human or animal recombinant polypeptide compositions is a substrate for one or more proteases including meprin, neprilysin (CD10), PSMA, BMP-1, A disintegrin and metalloproteinases (ADAMs), ADAM8, ADAM9, ADAM10, ADAM12, ADAM15, ADAM17 (TACE), ADAM19, ADAM28 (MDC-L), ADAM with thrombospondin motifs (ADAMTS), ADAMTS1, ADAMTS4, ADAMTS5, MMP-1 (collagenase 1), matrix metalloproteinase-1 (MMP-1), matrix metalloproteinase-2 (MMP-2, gelatinase A), matrix metalloproteinase-3 (MMP-3, stromelysin 1), matrix metalloproteinase-7 (MMP-7, Matrilysin 1), matrix metalloproteinase-8 (MMP-8, collagenase 2), matrix metalloproteinase-9 (MMP-9, gelatinase B), matrix metalloproteinase-10 (MMP-10, stromelysin 2), matrix metalloproteinase-11 (MMP-11, stromelysin 3), matrix metalloproteinase-12 (MMP-12, macrophage elastase), matrix metalloproteinase-13 (MMP-13, collagenase 3), matrix metalloproteinase-14 (MMP-14, MT1-MMP), matrix metalloproteinase-15 (MMP-15, MT2-MMP), matrix metalloproteinase-19 (MMP-19), matrix metalloproteinase-23 (MMP-23, CA-MMP), matrix metalloproteinase-24 (MMP-24, MT5-MMP), matrix metalloproteinase-26 (MMP-26, matrilysin 2), matrix metalloproteinase-27 (MMP-27, CMMP), legumain, cathepsin B, cathepsin C, cathepsin K, cathepsin L, cathepsin S, cathepsin X, cathepsin D, cathepsin E, secretase, urokinase (uPA), tissue-type plasminogen activator (tPA), plasmin, thrombin, prostate-specific antigen (PSA, KLK3), human neutrophil elastase (HNE), elastase, tryptase, Type II transmembrane serine proteases (TTSPs), DESC1, hepsin (HPN), matriptase, matriptase-2, TMPRSS2, TMPRSS3, TMPRSS4 (CAP2), fibroblast activation protein (FAP), kallikrein-related peptidase (KLK family), KLK4, KLK5, KLK6, KLK7, KLK8, KLK10, KLK11, KLK13, and KLK14. In one embodiment, the RS is a substrate for ADAM17. In one embodiment, the RS is a substrate for BMP-1. In one embodiment, the RS is a substrate for cathepsin. In one embodiment, the RS is a substrate for HtrA1. In one embodiment, the RS is a substrate for legumain. In one embodiment, the RS is a substrate for MMP-1. In one embodiment, the RS is a substrate for MMP-2. In one embodiment, the RS is a substrate for MMP-7. In one embodiment, the RS is a substrate for MMP-9. In one embodiment, the RS is a substrate for MMP-11. In one embodiment, the RS is a substrate for MMP-14. In one embodiment, the RS is a substrate for uPA. In one embodiment, the RS is a substrate for matriptase. In one embodiment, the RS is a substrate for MT-SP1. In one embodiment, the RS is a substrate for neutrophil elastase. In one embodiment, the RS is a substrate for thrombin. In one embodiment RS is a substrate for TMPRSS3. In one embodiment, the RS is a substrate for TMPRSS4. In one embodiment, the RS of the human or animal recombinant polypeptide compositions is a substrate for at least two proteases that are legumain, MMP-1, MMP-2, MMP-7, MMP-9, MMP-11, MMP-14, uPA, and matriptase. In another embodiment, the RS of the human or animal recombinant polypeptide compositions is a substrate for legumain, MMP-1, MMP-2, MMP-7, MMP-9, MMP-11, MMP-14, uPA, and matriptase.

TABLE 8a

BP Release Segment Sequences.

| Name | Construct ID | Amino Acid Sequence | SEQ ID NO: |
|---|---|---|---|
| RSR-1517 | AC1611 | EAGRSANHEPLGLVAT | 8261 |
| BSRS-A1 | AC1605 | ASGRSTNAGPSGLAGP | 8262 |
| BSRS-A2 | AC1606 | ASGRSTNAGPQGLAGQ | 8263 |
| BSRS-A3 | AC1607 | ASGRSTNAGPPGLTGP | 8264 |
| VP-1 | AC1608 | ASSRGTNAGPAGLTGP | 8265 |
| RSR-1752 | AC1609 | ASSRTTNTGPSTLTGP | 8266 |
| RSR-1512 | AC1610 | AAGRSDNGTPLELVAP | 8267 |
| RSR-1517 | AC1611 | EAGRSANHEPLGLVAT | 8261 |
| VP-2 | AC1612 | ASGRGTNAGPAGLTGP | 8268 |
| RSR-1018 | AC1613 | LFGRNDNHEPLELGGG | 8269 |
| RSR-1053 | AC1614 | TAGRSDNLEPLGLVFG | 8270 |
| RSR-1059 | AC1615 | LDGRSDNFHPPELVAG | 8271 |
| RSR-1065 | AC1616 | LEGRSDNEEPENLVAG | 8272 |
| RSR-1167 | AC1617 | LKGRSDNNAPLALVAG | 8273 |
| RSR-1201 | AC1618 | VYSRGTNAGPHGLTGR | 8274 |
| RSR-1218 | AC1619 | ANSRGTNKGFAGLIGP | 8275 |
| RSR-1226 | AC1620 | ASSRLTNEAPAGLTIP | 8276 |
| RSR-1254 | AC1621 | DQSRGTNAGPEGLTDP | 8277 |
| RSR-1256 | AC1622 | ESSRGTNIGQGGLTGP | 8278 |

TABLE 8a-continued

BP Release Segment Sequences.

| Name | Construct ID | Amino Acid Sequence | SEQ ID NO: |
|---|---|---|---|
| RSR-1261 | AC1623 | SSSRGTNQDPAGLTIP | 8279 |
| RSR-1293 | AC1624 | ASSRGQNHSPMGLTGP | 8280 |
| RSR-1309 | AC1625 | AYSRGPNAGPAGLEGR | 8281 |
| RSR-1326 | AC1626 | ASERGNNAGPANLTGF | 8282 |
| RSR-1345 | AC1627 | ASHRGTNPKPAILTGP | 8283 |
| RSR-1354 | AC1628 | MSSRRTNANPAQLTGP | 8284 |
| RSR-1426 | AC1629 | GAGRTDNHEPLELGAA | 8285 |
| RSR-1478 | AC1630 | LAGRSENTAPLELTAG | 8286 |
| RSR-1479 | AC1631 | LEGRPDNHEPLALVAS | 8287 |
| RSR-1496 | AC1632 | LSGRSDNEEPLALPAG | 8288 |
| RSR-1508 | AC1633 | EAGRTDNHEPLELSAP | 8289 |
| RSR-1513 | AC1634 | EGGRSDNHGPLELVSG | 8290 |
| RSR-1516 | AC1635 | LSGRSDNEAPLELEAG | 8291 |
| RSR-1524 | AC1636 | LGGRADNHEPPELGAG | 8292 |
| RSR-1622 | AC1637 | PPSRGTNAEPAGLTGE | 8293 |
| RSR-1629 | AC1638 | ASTRGENAGPAGLEAP | 8294 |
| RSR-1664 | AC1639 | ESSRGTNGAPEGLTGP | 8295 |
| RSR-1667 | AC1640 | ASSRATNESPAGLTGE | 8296 |
| RSR-1709 | AC1641 | ASSRGENPPPGGLTGP | 8297 |
| RSR-1712 | AC1642 | AASRGTNTGPAELTGS | 8298 |
| RSR-1727 | AC1643 | AGSRTTNAGPGGLEGP | 8299 |
| RSR-1754 | AC1644 | APSRGENAGPATLTGA | 8300 |
| RSR-1819 | AC1645 | ESGRAANTGPPTLTAP | 8301 |
| RSR-1832 | AC1646 | NPGRAANEGPPGLPGS | 8302 |
| RSR-1855 | AC1647 | ESSRAANLTPPELTGP | 8303 |
| RSR-1911 | AC1648 | ASGRAANETPPGLTGA | 8304 |
| RSR-1929 | AC1649 | NSGRGENLGAPGLTGT | 8305 |
| RSR-1951 | AC1650 | TTGRAANLTPAGLTGP | 8306 |
| RSR-2295 | AC1761 | EAGRSANHTPAGLTGP | 8307 |
| RSR-2298 | AC1762 | ESGRAANTTPAGLTGP | 8308 |
| RSR-2038 | AC1679 | TTGRATEAANLTPAGLTGP | 8309 |
| RSR-2072 | AC1680 | TTGRAEEAANLTPAGLTGP | 8310 |
| RSR-2089 | AC1681 | TTGRAGEAANLTPAGLTGP | 8311 |
| RSR-2302 | AC1682 | TTGRATEAANATPAGLTGP | 8312 |
| RSR-3047 | AC1697 | TTGRAGEAEGATSAGATGP | 8313 |
| RSR-3052 | AC1698 | TTGEAGEAANATSAGATGP | 8314 |
| RSR-3043 | AC1699 | TTGEAGEAAGLTPAGLTGP | 8315 |
| RSR-3041 | AC1700 | TTGAAGEAANATPAGLTGP | 8316 |

TABLE 8a-continued

BP Release Segment Sequences.

| Name | Construct ID | Amino Acid Sequence | SEQ ID NO: |
|---|---|---|---|
| RSR-3044 | AC1701 | TTGRAGEAAGLTPAGLTGP | 8317 |
| RSR-3057 | AC1702 | TTGRAGEAANATSAGATGP | 8318 |
| RSR-3058 | AC1703 | TTGEAGEAAGATSAGATGP | 8319 |
| RSR-2485 | AC1763 | ESGRAANTEPPELGAG | 8320 |
| RSR-2486 | AC1764 | ESGRAANTAPEGLTGP | 8321 |
| RSR-2488 | AC1688 | EPGRAANHEPSGLTEG | 8322 |
| RSR-2599 | AC1706 | ESGRAANHTGAPPGGLTGP | 8323 |
| RSR-2706 | AC1716 | TTGRTGEGANATPGGLTGP | 8324 |
| RSR-2707 | AC1717 | RTGRSGEAANETPEGLEGP | 8325 |
| RSR-2708 | AC1718 | RTGRTGESANETPAGLGGP | 8326 |
| RSR-2709 | AC1719 | STGRTGEPANETPAGLSGP | 8327 |
| RSR-2710 | AC1720 | TTGRAGEPANATPTGLSGP | 8328 |
| RSR-2711 | AC1721 | RTGRPGEGANATPTGLPGP | 8329 |
| RSR-2712 | AC1722 | RTGRGGEAANATPSGLGGP | 8330 |
| RSR-2713 | AC1723 | STGRSGESANATPGGLGGP | 8331 |
| RSR-2714 | AC1724 | RTGRTGEEANATPAGLPGP | 8332 |
| RSR-2715 | AC1725 | ATGRPGEPANTTPEGLEGP | 8333 |
| RSR-2716 | AC1726 | STGRSGEPANATPGGLTGP | 8334 |
| RSR-2717 | AC1727 | PTGRGGEGANTTPTGLPGP | 8335 |
| RSR-2718 | AC1728 | PTGRSGEGANATPSGLTGP | 8336 |
| RSR-2719 | AC1729 | TTGRASEGANSTPAPLTEP | 8337 |
| RSR-2720 | AC1730 | TYGRAAEAANTTPAGLTAP | 8338 |
| RSR-2721 | AC1731 | TTGRATEGANATPAELTEP | 8339 |
| RSR-2722 | AC1732 | TVGRASEEANTTPASLTGP | 8340 |
| RSR-2723 | AC1733 | TTGRAPEAANATPAPLTGP | 8341 |
| RSR-2724 | AC1734 | TWGRATEPANATPAPLTSP | 8342 |
| RSR-2725 | AC1735 | TVGRASESANATPAELTSP | 8343 |
| RSR-2726 | AC1736 | TVGRAPEGANSTPAGLTGP | 8344 |
| RSR-2727 | AC1737 | TWGRATEAPNLEPATLTTP | 8345 |
| RSR-2728 | AC1738 | TTGRATEAPNLTPAPLTEP | 8346 |
| RSR-2729 | AC1739 | TOGRATEAPNLSPAALTSP | 8347 |
| RSR-2730 | AC1740 | TOGRAAEAPNLTPATLTAP | 8348 |
| RSR-2731 | AC1741 | TSGRAPEATNLAPAPLTGP | 8349 |
| RSR-2732 | AC1742 | TOGRAAEAANLTPAGLTEP | 8350 |
| RSR-2733 | AC1743 | TTGRAGSAPNLPPTGLTTP | 8351 |
| RSR-2734 | AC1744 | TTGRAGGAENLPPEGLTAP | 8352 |
| RSR-2735 | AC1745 | TTSRAGTATNLTPEGLTAP | 8353 |
| RSR-2736 | AC1746 | TTGRAGTATNLPPSGLTTP | 8354 |

TABLE 8a-continued

| BP Release Segment Sequences. | | | |
|---|---|---|---|
| Name | Construct ID | Amino Acid Sequence | SEQ ID NO: |
| RSR-2737 | AC1747 | TTARAGEAENLSPSGLTAP | 8355 |
| RSR-2738 | AC1748 | TTGRAGGAGNLAPGGLTEP | 8356 |
| RSR-2739 | AC1749 | TTGRAGTATNLPPEGLTGP | 8357 |
| RSR-2740 | AC1750 | TTGRAGGAANLAPTGLTEP | 8358 |
| RSR-2741 | AC1751 | TTGRAGTAENLAPSGLTTP | 8359 |
| RSR-2742 | AC1752 | TTGRAGSATNLGPGGLTGP | 8360 |
| RSR-2743 | AC1753 | TTARAGGAENLTPAGLTEP | 8361 |
| RSR-2744 | AC1754 | TTARAGSAENLSPSGLTGP | 8362 |
| RSR-2745 | AC1755 | TTARAGGAGNLAPEGLTTP | 8363 |
| RSR-2746 | AC1756 | TTSRAGAAENLTPTGLTGP | 8364 |
| RSR-2747 | AC1757 | TYGRTTTPGNEPPASLEAE | 8365 |
| RSR-2748 | AC1758 | TYSRGESGPNEPPPGLTGP | 8366 |
| RSR-2749 | AC1759 | AWGRTGASENETPAPLGGE | 8367 |
| RSR-2750 | AC1760 | RWGRAETTPNTPPEGLETE | 8368 |
| RSR-2751 | AC1765 | ESGRAANHTGAEPPELGAG | 8369 |
| RSR-2754 | AC1801 | TTGRAGEAANLTPAGLTES | 8370 |
| RSR-2755 | AC1802 | TTGRAGEAANLTPAALTES | 8371 |
| RSR-2756 | AC1803 | TTGRAGEAANLTPAPLTES | 8372 |
| RSR-2757 | AC1804 | TTGRAGEAANLTPEPLTES | 8373 |
| RSR-2758 | AC1805 | TTGRAGEAANLTPAGLTGA | 8374 |
| RSR-2759 | AC1806 | TTGRAGEAANLTPEGLTGA | 8375 |
| RSR-2760 | AC1807 | TTGRAGEAANLTPEPLTGA | 8376 |
| RSR-2761 | AC1808 | TTGRAGEAANLTPAGLTEA | 8377 |
| RSR-2762 | AC1809 | TTGRAGEAANLTPEGLTEA | 8378 |
| RSR-2763 | AC1810 | TTGRAGEAANLTPAPLTEA | 8379 |
| RSR-2764 | AC1811 | TTGRAGEAANLTPEPLTEA | 8380 |
| RSR-2765 | AC1812 | TTGRAGEAANLTPEPLTGP | 8381 |
| RSR-2766 | AC1813 | TTGRAGEAANLTPAGLTGG | 8382 |
| RSR-2767 | AC1814 | TTGRAGEAANLTPEGLTGG | 8383 |
| RSR-2768 | AC1815 | TTGRAGEAANLTPEALTGG | 8384 |
| RSR-2769 | AC1816 | TTGRAGEAANLTPEPLTGG | 8385 |
| RSR-2770 | AC1817 | TTGRAGEAANLTPAGLTEG | 8386 |
| RSR-2771 | AC1818 | TTGRAGEAANLTPEGLTEG | 8387 |
| RSR-2772 | AC1819 | TTGRAGEAANLTPAPLTEG | 8388 |
| RSR-2773 | AC1820 | TTGRAGEAANLTPEPLTEG | 8389 |

TABLE 8b

| Release Segment Sequences | | | | | |
|---|---|---|---|---|---|
| Name | Amino Acid Sequence | SEQ ID NO: | Name | Amino Acid Sequence | SEQ ID NO: |
| RSN-0001 | GSAPGSAGGYAELRMGGAI ATSGSETPGT | 8390 | RSC-0001 | GTAEAASASGGSAGGYAEL RMGGAIPGSP | 8635 |
| RSN-0002 | GSAPGTGGGYAPLRMGGGA ATSGSETPGT | 8391 | RSC-0002 | GTAEAASASGGTGGGYAPL RMGGGAPGSP | 8636 |
| RSN-0003 | GSAPGAEGGYAALRMGGEI ATSGSETPGT | 8392 | RSC-0003 | GTAEAASASGGAEGGYAAL RMGGEIPGSP | 8637 |
| RSN-0004 | GSAPGGPGGYALLRMGGPA ATSGSETPGT | 8393 | RSC-0004 | GTAEAASASGGGPGGYALL RMGGPAPGSP | 8638 |
| RSN-0005 | GSAPGEAGGYAFLRMGGSI ATSGSETPGT | 8394 | RSC-0005 | GTAEAASASGGEAGGYAFL RMGGSIPGSP | 8639 |
| RSN-0006 | GSAPGPGGGYASLRMGGTA ATSGSETPGT | 8395 | RSC-0006 | GTAEAASASGGPGGGYASL RMGGTAPGSP | 8640 |
| RSN-0007 | GSAPGSEGGYATLRMGGAI ATSGSETPGT | 8396 | RSC-0007 | GTAEAASASGGSEGGYATL RMGGAIPGSP | 8641 |
| RSN-0008 | GSAPGTPGGYANLRMGGGA ATSGSETPGT | 8397 | RSC-0008 | GTAEAASASGGTPGGYANL RMGGGAPGSP | 8642 |
| RSN-0009 | GSAPGASGGYAHLRMGGEI ATSGSETPGT | 8398 | RSC-0009 | GTAEAASASGGASGGYAHL RMGGEIPGSP | 8643 |
| RSN-0010 | GSAPGGTGGYGELRMGGPA ATSGSETPGT | 8399 | RSC-0010 | GTAEAASASGGGTGGYGEL RMGGPAPGSP | 8644 |
| RSN-0011 | GSAPGEAGGYPELRMGGSIA TSGSETPGT | 8400 | RSC-0011 | GTAEAASASGGEAGGYPEL RMGGSIPGSP | 8645 |
| RSN-0012 | GSAPGPGGGYVELRMGGTA ATSGSETPGT | 8401 | RSC-0012 | GTAEAASASGGPGGGYVEL RMGGTAPGSP | 8646 |
| RSN-0013 | GSAPGSEGGYLELRMGGAI ATSGSETPGT | 8402 | RSC-0013 | GTAEAASASGGSEGGYLELR MGGAIPGSP | 8647 |
| RSN-0014 | GSAPGTPGGYSELRMGGGA ATSGSETPGT | 8403 | RSC-0014 | GTAEAASASGGTPGGYSELR MGGGAPGSP | 8648 |
| RSN-0015 | GSAPGASGGYTELRMGGEI ATSGSETPGT | 8404 | RSC-0015 | GTAEAASASGGASGGYTEL RMGGEIPGSP | 8649 |
| RSN-0016 | GSAPGGTGGYQELRMGGPA ATSGSETPGT | 8405 | RSC-0016 | GTAEAASASGGGTGGYQEL RMGGPAPGSP | 8650 |
| RSN-0017 | GSAPGEAGGYEELRMGGSI ATSGSETPGT | 8406 | RSC-0017 | GTAEAASASGGEAGGYEEL RMGGSIPGSP | 8651 |
| RSN-0018 | GSAPGPGIGPAELRMGGTAA TSGSETPGT | 8407 | RSC-0018 | GTAEAASASGGPGIGPAELR MGGTAPGSP | 8652 |
| RSN-0019 | GSAPGSEIGAAELRMGGAIA TSGSETPGT | 8408 | RSC-0019 | GTAEAASASGGSEIGAAELR MGGAIPGSP | 8653 |
| RSN-0020 | GSAPGTPIGSAELRMGGGAA TSGSETPGT | 8409 | RSC-0020 | GTAEAASASGGTPIGSAELR MGGGAPGSP | 8654 |
| RSN-0021 | GSAPGASIGTAELRMGGEIA TSGSETPGT | 8410 | RSC-0021 | GTAEAASASGGASIGTAELR MGGEIPGSP | 8655 |
| RSN-0022 | GSAPGGTIGNAELRMGGPA ATSGSETPGT | 8411 | RSC-0022 | GTAEAASASGGGTIGNAELR MGGPAPGSP | 8656 |
| RSN-0023 | GSAPGEAIGQAELRMGGSIA TSGSETPGT | 8412 | RSC-0023 | GTAEAASASGGEAIGQAELR MGGSIPGSP | 8657 |
| RSN-0024 | GSAPGPGGPYAELRMGGTA ATSGSETPGT | 8413 | RSC-0024 | GTAEAASASGGPGGPYAELR MGGTAPGSP | 8658 |
| RSN-0025 | GSAPGSEGAYAELRMGGAI ATSGSETPGT | 8414 | RSC-0025 | GTAEAASASGGSEGAYAEL RMGGAIPGSP | 8659 |

TABLE 8b-continued

Release Segment Sequences

| Name | Amino Acid Sequence | SEQ ID NO: | Name | Amino Acid Sequence | SEQ ID NO: |
|---|---|---|---|---|---|
| RSN-0026 | GSAPGTPGVYAELRMGGGA ATSGSETPGT | 8415 | RSC-0026 | GTAEAASASGGTPGVYAEL RMGGGAPGSP | 8660 |
| RSN-0027 | GSAPGASGLYAELRMGGEI ATSGSETPGT | 8416 | RSC-0027 | GTAEAASASGGASGLYAEL RMGGEIPGSP | 8661 |
| RSN-0028 | GSAPGGTGIYAELRMGGPA ATSGSETPGT | 8417 | RSC-0028 | GTAEAASASGGGTGIYAELR MGGPAPGSP | 8662 |
| RSN-0029 | GSAPGEAGFYAELRMGGSIA TSGSETPGT | 8418 | RSC-0029 | GTAEAASASGGEAGFYAEL RMGGSIPGSP | 8663 |
| RSN-0030 | GSAPGPGGYYAELRMGGTA ATSGSETPGT | 8419 | RSC-0030 | GTAEAASASGGPGGYYAEL RMGGTAPGSP | 8664 |
| RSN-0031 | GSAPGSEGSYAELRMGGAIA TSGSETPGT | 8420 | RSC-0031 | GTAEAASASGGSEGSYAELR MGGAIPGSP | 8665 |
| RSN-0032 | GSAPGTPGNYAELRMGGGA ATSGSETPGT | 8421 | RSC-0032 | GTAEAASASGGTPGNYAEL RMGGGAPGSP | 8666 |
| RSN-0033 | GSAPGASGEYAELRMGGEI ATSGSETPGT | 8422 | RSC-0033 | GTAEAASASGGASGEYAEL RMGGEIPGSP | 8667 |
| RSN-0034 | GSAPGGTGHYAELRMGGPA ATSGSETPGT | 8423 | RSC-0034 | GTAEAASASGGGTGHYAEL RMGGPAPGSP | 8668 |
| RSN-0035 | GSAPGEAGGYAEARMGGSI ATSGSETPGT | 8424 | RSC-0035 | GTAEAASASGGEAGGYAEA RMGGSIPGSP | 8669 |
| RSN-0036 | GSAPGPGGGYAEVRMGGTA ATSGSETPGT | 8425 | RSC-0036 | GTAEAASASGGPGGGYAEV RMGGTAPGSP | 8670 |
| RSN-0037 | GSAPGSEGGYAEIRMGGAIA TSGSETPGT | 8426 | RSC-0037 | GTAEAASASGGSEGGYAEIR MGGAIPGSP | 8671 |
| RSN-0038 | GSAPGTPGGYAEFRMGGGA ATSGSETPGT | 8427 | RSC-0038 | GTAEAASASGGTPGGYAEFR MGGGAPGSP | 8672 |
| RSN-0039 | GSAPGASGGYAEYRMGGEI ATSGSETPGT | 8428 | RSC-0039 | GTAEAASASGGASGGYAEY RMGGEIPGSP | 8673 |
| RSN-0040 | GSAPGGTGGYAESRMGGPA ATSGSETPGT | 8429 | RSC-0040 | GTAEAASASGGGTGGYAES RMGGPAPGSP | 8674 |
| RSN-0041 | GSAPGEAGGYAETRMGGSI ATSGSETPGT | 8430 | RSC-0041 | GTAEAASASGGEAGGYAET RMGGSIPGSP | 8675 |
| RSN-0042 | GSAPGPGGGYAELAMGGTR ATSGSETPGT | 8431 | RSC-0042 | GTAEAASASGGPGGGYAEL AMGGTRPGSP | 8676 |
| RSN-0043 | GSAPGSEGGYAELVMGGAR ATSGSETPGT | 8432 | RSC-0043 | GTAEAASASGGSEGGYAEL VMGGARPGSP | 8677 |
| RSN-0044 | GSAPGTPGGYAELLMGGGR ATSGSETPGT | 8433 | RSC-0044 | GTAEAASASGGTPGGYAELL MGGGRPGSP | 8678 |
| RSN-0045 | GSAPGASGGYAELIMGGER ATSGSETPGT | 8434 | RSC-0045 | GTAEAASASGGASGGYAELI MGGERPGSP | 8679 |
| RSN-0046 | GSAPGGTGGYAELWMGGP RATSGSETPGT | 8435 | RSC-0046 | GTAEAASASGGGTGGYAEL WMGGPRPGSP | 8680 |
| RSN-0047 | GSAPGEAGGYAELSMGGSR ATSGSETPGT | 8436 | RSC-0047 | GTAEAASASGGEAGGYAEL SMGGSRPGSP | 8681 |
| RSN-0048 | GSAPGPGGGYAELTMGGTR ATSGSETPGT | 8437 | RSC-0048 | GTAEAASASGGPGGGYAEL TMGGTRPGSP | 8682 |
| RSN-0049 | GSAPGSEGGYAELQMGGAR ATSGSETPGT | 8438 | RSC-0049 | GTAEAASASGGSEGGYAEL QMGGARPGSP | 8683 |
| RSN-0050 | GSAPGTPGGYAELNMGGGR ATSGSETPGT | 8439 | RSC-0050 | GTAEAASASGGTPGGYAEL NMGGGRPGSP | 8684 |

TABLE 8b-continued

| Release Segment Sequences | | | | | |
|---|---|---|---|---|---|
| Name | Amino Acid Sequence | SEQ ID NO: | Name | Amino Acid Sequence | SEQ ID NO: |
| RSN-0051 | GSAPGASGGYAELEMGGER ATSGSETPGT | 8440 | RSC-0051 | GTAEAASASGGASGGYAEL EMGGERPGSP | 8685 |
| RSN-0052 | GSAPGGTGGYAELRPGGPIA TSGSETPGT | 8441 | RSC-0052 | GTAEAASASGGGTGGYAEL RPGGPIPGSP | 8686 |
| RSN-0053 | GSAPGEAGGYAELRAGGSA ATSGSETPGT | 8442 | RSC-0053 | GTAEAASASGGEAGGYAEL RAGGSAPGSP | 8687 |
| RSN-0054 | GSAPGPGGGYAELRLGGTIA TSGSETPGT | 8443 | RSC-0054 | GTAEAASASGGPGGGYAEL RLGGTIPGSP | 8688 |
| RSN-0055 | GSAPGSEGGYAELRIGGAAA TSGSETPGT | 8444 | RSC-0055 | GTAEAASASGGSEGGYAEL RIGGAAPGSP | 8689 |
| RSN-0056 | GSAPGTPGGYAELRSGGGIA TSGSETPGT | 8445 | RSC-0056 | GTAEAASASGGTPGGYAEL RSGGGIPGSP | 8690 |
| RSN-0057 | GSAPGASGGYAELRNGGEA ATSGSETPGT | 8446 | RSC-0057 | GTAEAASASGGASGGYAEL RNGGEAPGSP | 8691 |
| RSN-0058 | GSAPGGTGGYAELRQGGPIA TSGSETPGT | 8447 | RSC-0058 | GTAEAASASGGGTGGYAEL ROGGPIPGSP | 8692 |
| RSN-0059 | GSAPGEAGGYAELRDGGSA ATSGSETPGT | 8448 | RSC-0059 | GTAEAASASGGEAGGYAEL RDGGSAPGSP | 8693 |
| RSN-0060 | GSAPGPGGGYAELREGGTIA TSGSETPGT | 8449 | RSC-0060 | GTAEAASASGGPGGGYAEL REGGTIPGSP | 8694 |
| RSN-0061 | GSAPGSEGGYAELRHGGAA ATSGSETPGT | 8450 | RSC-0061 | GTAEAASASGGSEGGYAEL RHGGAAPGSP | 8695 |
| RSN-0062 | GSAPGTPGGYAELRMPGGIA TSGSETPGT | 8451 | RSC-0062 | GTAEAASASGGTPGGYAEL RMPGGIPGSP | 8696 |
| RSN-0063 | GSAPGASGGYAELRMAGEA ATSGSETPGT | 8452 | RSC-0063 | GTAEAASASGGASGGYAEL RMAGEAPGSP | 8697 |
| RSN-0064 | GSAPGGTGGYAELRMVGPI ATSGSETPGT | 8453 | RSC-0064 | GTAEAASASGGGTGGYAEL RMVGPIPGSP | 8698 |
| RSN-0065 | GSAPGEAGGYAELRMLGSA ATSGSETPGT | 8454 | RSC-0065 | GTAEAASASGGEAGGYAEL RMLGSAPGSP | 8699 |
| RSN-0066 | GSAPGPGGGYAELRMIGTIA TSGSETPGT | 8455 | RSC-0066 | GTAEAASASGGPGGGYAEL RMIGTIPGSP | 8700 |
| RSN-0067 | GSAPGSEGGYAELRMYGAI ATSGSETPGT | 8456 | RSC-0067 | GTAEAASASGGSEGGYAEL RMYGAIPGSP | 8701 |
| RSN-0068 | GSAPGTPGGYAELRMSGGA ATSGSETPGT | 8457 | RSC-0068 | GTAEAASASGGTPGGYAEL RMSGGAPGSP | 8702 |
| RSN-0069 | GSAPGASGGYAELRMNGEI ATSGSETPGT | 8458 | RSC-0069 | GTAEAASASGGASGGYAEL RMNGEIPGSP | 8703 |
| RSN-0070 | GSAPGGTGGYAELRMQGPA ATSGSETPGT | 8459 | RSC-0070 | GTAEAASASGGGTGGYAEL RMQGPAPGSP | 8704 |
| RSN-0071 | GSAPGANHTPAGLTGPGAR ATSGSETPGT | 8460 | RSC-0071 | GTAEAASASGGANHTPAGL TGPGARPGSP | 8705 |
| RSN-0072 | GSAPGANTAPEGLTGPSTRA TSGSETPGT | 8461 | RSC-0072 | GTAEAASASGGANTAPEGLT GPSTRPGSP | 8706 |
| RSN-0073 | GSAPGTGAPPGGLTGPGTRA TSGSETPGT | 8462 | RSC-0073 | GTAEAASASGGTGAPPGGLT GPGTRPGSP | 8707 |
| RSN-0074 | GSAPGANHEPSGLTEGSPRA TSGSETPGT | 8463 | RSC-0074 | GTAEAASASGGANHEPSGLT EGSPRPGSP | 8708 |
| RSN-0075 | GSAPGANTEPPELGAGTERA TSGSETPGT | 8464 | RSC-0075 | GTAEAASASGGANTEPPELG AGTERPGSP | 8709 |

TABLE 8b-continued

| Release Segment Sequences | | | | | |
|---|---|---|---|---|---|
| Name | Amino Acid Sequence | SEQ ID NO: | Name | Amino Acid Sequence | SEQ ID NO: |
| RSN-0076 | GSAPGASGPPPGLTGPPGRA TSGSETPGT | 8465 | RSC-0076 | GTAEAASASGGASGPPPGLT GPPGRPGSP | 8710 |
| RSN-0077 | GSAPGASGTPAPLGGEPGRA TSGSETPGT | 8466 | RSC-0077 | GTAEAASASGGASGTPAPLG GEPGRPGSP | 8711 |
| RSN-0078 | GSAPGPAGPPEGLETEAGRA TSGSETPGT | 8467 | RSC-0078 | GTAEAASASGGPAGPPEGLE TEAGRPGSP | 8712 |
| RSN-0079 | GSAPGPTSGQGGLTGPESRA TSGSETPGT | 8468 | RSC-0079 | GTAEAASASGGPTSGQGGLT GPESRPGSP | 8713 |
| RSN-0080 | GSAPGSAGGAANLVRGGAI ATSGSETPGT | 8469 | RSC-0080 | GTAEAASASGGSAGGAANL VRGGAIPGSP | 8714 |
| RSN-0081 | GSAPGTGGGAAPLVRGGGA ATSGSETPGT | 8470 | RSC-0081 | GTAEAASASGGTGGGAAPL VRGGGAPGSP | 8715 |
| RSN-0082 | GSAPGAEGGAAALVRGGEI ATSGSETPGT | 8471 | RSC-0082 | GTAEAASASGGAEGGAAAL VRGGEIPGSP | 8716 |
| RSN-0083 | GSAPGGPGGAALLVRGGPA ATSGSETPGT | 8472 | RSC-0083 | GTAEAASASGGGPGGAALL VRGGPAPGSP | 8717 |
| RSN-0084 | GSAPGEAGGAAFLVRGGSIA TSGSETPGT | 8473 | RSC-0084 | GTAEAASASGGEAGGAAFL VRGGSIPGSP | 8718 |
| RSN-0085 | GSAPGPGGGAASLVRGGTA ATSGSETPGT | 8474 | RSC-0085 | GTAEAASASGGPGGGAASL VRGGTAPGSP | 8719 |
| RSN-0086 | GSAPGSEGGAATLVRGGAIA TSGSETPGT | 8475 | RSC-0086 | GTAEAASASGGSEGGAATL VRGGAIPGSP | 8720 |
| RSN-0087 | GSAPGTPGGAAGLVRGGGA ATSGSETPGT | 8476 | RSC-0087 | GTAEAASASGGTPGGAAGL VRGGGAPGSP | 8721 |
| RSN-0088 | GSAPGASGGAADLVRGGEI ATSGSETPGT | 8477 | RSC-0088 | GTAEAASASGGASGGAADL VRGGEIPGSP | 8722 |
| RSN-0089 | GSAPGGTGGAGNLVRGGPA ATSGSETPGT | 8478 | RSC-0089 | GTAEAASASGGGTGGAGNL VRGGPAPGSP | 8723 |
| RSN-0090 | GSAPGEAGGAPNLVRGGSIA TSGSETPGT | 8479 | RSC-0090 | GTAEAASASGGEAGGAPNL VRGGSIPGSP | 8724 |
| RSN-0091 | GSAPGPGGGAVNLVRGGTA ATSGSETPGT | 8480 | RSC-0091 | GTAEAASASGGPGGGAVNL VRGGTAPGSP | 8725 |
| RSN-0092 | GSAPGSEGGALNLVRGGAIA TSGSETPGT | 8481 | RSC-0092 | GTAEAASASGGSEGGALNL VRGGAIPGSP | 8726 |
| RSN-0093 | GSAPGTPGGASNLVRGGGA ATSGSETPGT | 8482 | RSC-0093 | GTAEAASASGGTPGGASNL VRGGGAPGSP | 8727 |
| RSN-0094 | GSAPGASGGATNLVRGGEIA TSGSETPGT | 8483 | RSC-0094 | GTAEAASASGGASGGATNL VRGGEIPGSP | 8728 |
| RSN-0095 | GSAPGGTGGAQNLVRGGPA ATSGSETPGT | 8484 | RSC-0095 | GTAEAASASGGGTGGAQNL VRGGPAPGSP | 8729 |
| RSN-0096 | GSAPGEAGGAENLVRGGSIA TSGSETPGT | 8485 | RSC-0096 | GTAEAASASGGEAGGAENL VRGGSIPGSP | 8730 |
| RSN-1517 | GSAPEAGRSANHEPLGLVAT ATSGSETPGT | 8486 | RSC-1517 | GTAEAASASGEAGRSANHEP LGLVATPGSP | 8731 |
| BSRS-A1 | GSAPASGRSTNAGPSGLAGP ATSGSETPGT | 8487 | BSRS-A1 | GTAEAASASGASGRSTNAGP SGLAGPPGSP | 8732 |
| BSRS-A2 | GSAPASGRSTNAGPQGLAG QATSGSETPGT | 8488 | BSRS-A2 | GTAEAASASGASGRSTNAGP QGLAGQPGSP | 8733 |
| BSRS-A3 | GSAPASGRSTNAGPPGLTGP ATSGSETPGT | 8489 | BSRS-A3 | GTAEAASASGASGRSTNAGP PGLTGPPGSP | 8734 |

TABLE 8b-continued

Release Segment Sequences

| Name | Amino Acid Sequence | SEQ ID NO: | Name | Amino Acid Sequence | SEQ ID NO: |
|---|---|---|---|---|---|
| VP-1 | GSAPASSRGTNAGPAGLTGP ATSGSETPGT | 8490 | VP-1 | GTAEAASASGASSRGTNAGP AGLTGPPGSP | 8735 |
| RSN-1752 | GSAPASSRTTNTGPSTLTGP ATSGSETPGT | 8491 | RSC-1752 | GTAEAASASGASSRTTNTGP STLTGPPGSP | 8736 |
| RSN-1512 | GSAPAAGRSDNGTPLELVAP ATSGSETPGT | 8492 | RSC-1512 | GTAEAASASGAAGRSDNGT PLEL VAPPGSP | 8737 |
| RSN-1517 | GSAPEAGRSANHEPLGLVAT ATSGSETPGT | 8486 | RSC-1517 | GTAEAASASGEAGRSANHEP LGLVATPGSP | 8731 |
| VP-2 | GSAPASGRGTNAGPAGLTG PATSGSETPGT | 8493 | VP-2 | GTAEAASASGASGRGTNAG PAGLTGPPGSP | 8738 |
| RSN-1018 | GSAPLFGRNDNHEPLELGGG ATSGSETPGT | 8494 | RSC-1018 | GTAEAASASGLFGRNDNHEP LELGGGPGSP | 8739 |
| RSN-1053 | GSAPTAGRSDNLEPLGLVFG ATSGSETPGT | 8495 | RSC-1053 | GTAEAASASGTAGRSDNLEP LGLVFGPGSP | 8740 |
| RSN-1059 | GSAPLDGRSDNFHPPELVAG ATSGSETPGT | 8496 | RSC-1059 | GTAEAASASGLDGRSDNFHP PEL VAGPGSP | 8741 |
| RSN-1065 | GSAPLEGRSDNEEPENLVAG ATSGSETPGT | 8497 | RSC-1065 | GTAEAASASGLEGRSDNEEP ENLVAGPGSP | 8742 |
| RSN-1167 | GSAPLKGRSDNNAPLALVA GATSGSETPGT | 8498 | RSC-1167 | GTAEAASASGLKGRSDNNA PLALVAGPGSP | 8743 |
| RSN-1201 | GSAPVYSRGTNAGPHGLTG RATSGSETPGT | 8499 | RSC-1201 | GTAEAASASGVYSRGTNAG PHGLTGRPGSP | 8744 |
| RSN-1218 | GSAPANSRGTNKGFAGLIGP ATSGSETPGT | 8500 | RSC-1218 | GTAEAASASGANSRGTNKG FAGLIGPPGSP | 8745 |
| RSN-1226 | GSAPASSRLTNEAPAGLTIPA TSGSETPGT | 8501 | RSC-1226 | GTAEAASASGASSRLTNEAP AGLTIPPGSP | 8746 |
| RSN-1254 | GSAPDQSRGTNAGPEGLTDP ATSGSETPGT | 8502 | RSC-1254 | GTAEAASASGDQSRGTNAG PEGLTDPPGSP | 8747 |
| RSN-1256 | GSAPESSRGTNIGQGGLTGP ATSGSETPGT | 8503 | RSC-1256 | GTAEAASASGESSRGTNIGQ GGLTGPPGSP | 8748 |
| RSN-1261 | GSAPSSSRGTNQDPAGLTIP ATSGSETPGT | 8504 | RSC-1261 | GTAEAASASGSSSRGTNQDP AGLTIPPGSP | 8749 |
| RSN-1293 | GSAPASSRGQNHSPMGLTGP ATSGSETPGT | 8505 | RSC-1293 | GTAEAASASGASSRGQNHSP MGLTGPPGSP | 8750 |
| RSN-1309 | GSAPAYSRGPNAGPAGLEG RATSGSETPGT | 8506 | RSC-1309 | GTAEAASASGAYSRGPNAG PAGLEGRPGSP | 8751 |
| RSN-1326 | GSAPASERGNNAGPANLTG FATSGSETPGT | 8507 | RSC-1326 | GTAEAASASGASERGNNAG PANLTGFPGSP | 8752 |
| RSN-1345 | GSAPASHRGTNPKPAILTGP ATSGSETPGT | 8508 | RSC-1345 | GTAEAASASGASHRGTNPKP AILTGPPGSP | 8753 |
| RSN-1354 | GSAPMSSRRTNANPAQLTGP ATSGSETPGT | 8509 | RSC-1354 | GTAEAASASGMSSRRTNAN PAQLTGPPGSP | 8754 |
| RSN-1426 | GSAPGAGRTDNHEPLELGA AATSGSETPGT | 8510 | RSC-1426 | GTAEAASASGGAGRTDNHE PLELGAAPGSP | 8755 |
| RSN-1478 | GSAPLAGRSENTAPLELTAG ATSGSETPGT | 8511 | RSC-1478 | GTAEAASASGLAGRSENTAP LELTAGPGSP | 8756 |
| RSN-1479 | GSAPLEGRPDNHEPLALVAS ATSGSETPGT | 8512 | RSC-1479 | GTAEAASASGLEGRPDNHEP LALVASPGSP | 8757 |
| RSN-1496 | GSAPLSGRSDNEEPLALPAG ATSGSETPGT | 8513 | RSC-1496 | GTAEAASASGLSGRSDNEEP LALPAGPGSP | 8758 |

TABLE 8b-continued

Release Segment Sequences

| Name | Amino Acid Sequence | SEQ ID NO: | Name | Amino Acid Sequence | SEQ ID NO: |
|---|---|---|---|---|---|
| RSN-1508 | GSAPEAGRTDNHEPLELSAP ATSGSETPGT | 8514 | RSC-1508 | GTAEAASASGEAGRTDNHE PLELSAPPGSP | 8759 |
| RSN-1513 | GSAPEGGRSDNHGPLELVSG ATSGSETPGT | 8515 | RSC-1513 | GTAEAASASGEGGRSDNHG PLELVSGPGSP | 8760 |
| RSN-1516 | GSAPLSGRSDNEAPLELEAG ATSGSETPGT | 8516 | RSC-1516 | GTAEAASASGLSGRSDNEAP LELEAGPGSP | 8761 |
| RSN-1524 | GSAPLGGRADNHEPPELGA GATSGSETPGT | 8517 | RSC-1524 | GTAEAASASGLGGRADNHE PPELGAGPGSP | 8762 |
| RSN-1622 | GSAPPPSRGTNAEPAGLTGE ATSGSETPGT | 8518 | RSC-1622 | GTAEAASASGPPSRGTNAEP AGLTGEPGSP | 8763 |
| RSN-1629 | GSAPASTRGENAGPAGLEAP ATSGSETPGT | 8519 | RSC-1629 | GTAEAASASGASTRGENAGP AGLEAPPGSP | 8764 |
| RSN-1664 | GSAPESSRGTNGAPEGLTGP ATSGSETPGT | 8520 | RSC-1664 | GTAEAASASGESSRGTNGAP EGLTGPPGSP | 8765 |
| RSN-1667 | GSAPASSRATNESPAGLTGE ATSGSETPGT | 8521 | RSC-1667 | GTAEAASASGASSRATNESP AGLTGEPGSP | 8766 |
| RSN-1709 | GSAPASSRGENPPPGGLTGP ATSGSETPGT | 8522 | RSC-1709 | GTAEAASASGASSRGENPPP GGLTGPPGSP | 8767 |
| RSN-1712 | GSAPAASRGTNTGPAELTGS ATSGSETPGT | 8523 | RSC-1712 | GTAEAASASGAASRGTNTGP AELTGSPGSP | 8768 |
| RSN-1727 | GSAPAGSRTTNAGPGGLEGP ATSGSETPGT | 8524 | RSC-1727 | GTAEAASASGAGSRTTNAGP GGLEGPPGSP | 8769 |
| RSN-1754 | GSAPAPSRGENAGPATLTGA ATSGSETPGT | 8525 | RSC-1754 | GTAEAASASGAPSRGENAGP ATLTGAPGSP | 8770 |
| RSN-1819 | GSAPESGRAANTGPPTLTAP ATSGSETPGT | 8526 | RSC-1819 | GTAEAASASGESGRAANTGP PTLTAPPGSP | 8771 |
| RSN-1832 | GSAPNPGRAANEGPPGLPGS ATSGSETPGT | 8527 | RSC-1832 | GTAEAASASGNPGRAANEG PPGLPGSPGSP | 8772 |
| RSN-1855 | GSAPESSRAANLTPPELTGP ATSGSETPGT | 8528 | RSC-1855 | GTAEAASASGESSRAANLTP PELTGPPGSP | 8773 |
| RSN-1911 | GSAPASGRAANETPPGLTGA ATSGSETPGT | 8529 | RSC-1911 | GTAEAASASGASGRAANETP PGLTGAPGSP | 8774 |
| RSN-1929 | GSAPNSGRGENLGAPGLTGT ATSGSETPGT | 8530 | RSC-1929 | GTAEAASASGNSGRGENLG APGLTGTPGSP | 8775 |
| RSN-1951 | GSAPTTGRAANLTPAGLTGP ATSGSETPGT | 8531 | RSC-1951 | GTAEAASASGTTGRAANLTP AGLTGPPGSP | 8776 |
| RSN-2295 | GSAPEAGRSANHTPAGLTGP ATSGSETPGT | 8532 | RSC-2295 | GTAEAASASGEAGRSANHTP AGLTGPPGSP | 8777 |
| RSN-2298 | GSAPESGRAANTTPAGLTGP ATSGSETPGT | 8533 | RSC-2298 | GTAEAASASGESGRAANTTP AGLTGPPGSP | 8778 |
| RSN-2038 | GSAPTTGRATEAANLTPAGL TGPATSGSETPGT | 8534 | RSC-2038 | GTAEAASASGTTGRATEAA NLTPAGLTGPPGSP | 8779 |
| RSN-2072 | GSAPTTGRAEEAANLTPAGL TGPATSGSETPGT | 8535 | RSC-2072 | GTAEAASASGTTGRAEEAA NLTPAGLTGPPGSP | 8780 |
| RSN-2089 | GSAPTTGRAGEAANLTPAG LTGPATSGSETPGT | 8536 | RSC-2089 | GTAEAASASGTTGRAGEAA NLTPAGLTGPPGSP | 8781 |
| RSN-2302 | GSAPTTGRATEAANATPAG LTGPATSGSETPGT | 8537 | RSC-2302 | GTAEAASASGTTGRATEAA NATPAGLTGPPGSP | 8782 |
| RSN-3047 | GSAPTTGRAGEAEGATSAG ATGPATSGSETPGT | 8538 | RSC-3047 | GTAEAASASGTTGRAGEAE GATSAGATGPPGSP | 8783 |

TABLE 8b-continued

| Release Segment Sequences | | | | | |
|---|---|---|---|---|---|
| Name | Amino Acid Sequence | SEQ ID NO: | Name | Amino Acid Sequence | SEQ ID NO: |
| RSN-3052 | GSAPTTGEAGEAANATSAG ATGPATSGSETPGT | 8539 | RSC-3052 | GTAEAASASGTTGEAGEAA NATSAGATGPPGSP | 8784 |
| RSN-3043 | GSAPTTGEAGEAAGLTPAGL TGPATSGSETPGT | 8540 | RSC-3043 | GTAEAASASGTTGEAGEAA GLTPAGLTGPPGSP | 8785 |
| RSN-3041 | GSAPTTGAAGEAANATPAG LTGPATSGSETPGT | 8541 | RSC-3041 | GTAEAASASGTTGAAGEAA NATPAGLTGPPGSP | 8786 |
| RSN-3044 | GSAPTTGRAGEAAGLTPAG LTGPATSGSETPGT | 8542 | RSC-3044 | GTAEAASASGTTGRAGEAA GLTPAGLTGPPGSP | 8787 |
| RSN-3057 | GSAPTTGRAGEAANATSAG ATGPATSGSETPGT | 8543 | RSC-3057 | GTAEAASASGTTGRAGEAA NATSAGATGPPGSP | 8788 |
| RSN-3058 | GSAPTTGEAGEAAGATSAG ATGPATSGSETPGT | 8544 | RSC-3058 | GTAEAASASGTTGEAGEAA GATSAGATGPPGSP | 8789 |
| RSN-2485 | GSAPESGRAANTEPPELGAG ATSGSETPGT | 8545 | RSC-2485 | GTAEAASASGESGRAANTEP PELGAGPGSP | 8790 |
| RSN-2486 | GSAPESGRAANTAPEGLTGP ATSGSETPGT | 8546 | RSC-2486 | GTAEAASASGESGRAANTAP EGLTGPPGSP | 8791 |
| RSN-2488 | GSAPEPGRAANHEPSGLTEG ATSGSETPGT | 8547 | RSC-2488 | GTAEAASASGEPGRAANHEP SGLTEGPGSP | 8792 |
| RSN-2599 | GSAPESGRAANHTGAPPGG LTGPATSGSETPGT | 8548 | RSC-2599 | GTAEAASASGESGRAANHT GAPPGGLTGPPGSP | 8793 |
| RSN-2706 | GSAPTTGRTGEGANATPGG LTGPATSGSETPGT | 8549 | RSC-2706 | GTAEAASASGTTGRTGEGA NATPGGLTGPPGSP | 8794 |
| RSN-2707 | GSAPRTGRSGEAANETPEGL EGPATSGSETPGT | 8550 | RSC-2707 | GTAEAASASGRTGRSGEAA NETPEGLEGPPGSP | 8795 |
| RSN-2708 | GSAPRTGRTGESANETPAGL GGPATSGSETPGT | 8551 | RSC-2708 | GTAEAASASGRTGRTGESAN ETPAGLGGPPGSP | 8796 |
| RSN-2709 | GSAPSTGRTGEPANETPAGL SGPATSGSETPGT | 8552 | RSC-2709 | GTAEAASASGSTGRTGEPAN ETPAGLSGPPGSP | 8797 |
| RSN-2710 | GSAPTTGRAGEPANATPTGL SGPATSGSETPGT | 8553 | RSC-2710 | GTAEAASASGTTGRAGEPA NATPTGLSGPPGSP | 8798 |
| RSN-2711 | GSAPRTGRPGEGANATPTGL PGPATSGSETPGT | 8554 | RSC-2711 | GTAEAASASGRTGRPGEGA NATPTGLPGPPGSP | 8799 |
| RSN-2712 | GSAPRTGRGGEAANATPSG LGGPATSGSETPGT | 8555 | RSC-2712 | GTAEAASASGRTGRGGEAA NATPSGLGGPPGSP | 8800 |
| RSN-2713 | GSAPSTGRSGESANATPGGL GGPATSGSETPGT | 8556 | RSC-2713 | GTAEAASASGSTGRSGESAN ATPGGLGGPPGSP | 8801 |
| RSN-2714 | GSAPRTGRTGEEANATPAGL PGPATSGSETPGT | 8557 | RSC-2714 | GTAEAASASGRTGRTGEEA NATPAGLPGPPGSP | 8802 |
| RSN-2715 | GSAPATGRPGEPANTTPEGL EGPATSGSETPGT | 8558 | RSC-2715 | GTAEAASASGATGRPGEPAN TTPEGLEGPPGSP | 8803 |
| RSN-2716 | GSAPSTGRSGEPANATPGGL TGPATSGSETPGT | 8559 | RSC-2716 | GTAEAASASGSTGRSGEPAN ATPGGLTGPPGSP | 8804 |
| RSN-2717 | GSAPPTGRGGEGANTTPTGL PGPATSGSETPGT | 8560 | RSC-2717 | GTAEAASASGPTGRGGEGA NTTPTGLPGPPGSP | 8805 |
| RSN-2718 | GSAPPTGRSGEGANATPSGL TGPATSGSETPGT | 8561 | RSC-2718 | GTAEAASASGPTGRSGEGAN ATPSGLTGPPGSP | 8806 |
| RSN-2719 | GSAPTTGRASEGANSTPAPL TEPATSGSETPGT | 8562 | RSC-2719 | GTAEAASASGTTGRASEGA NSTPAPLTEPPGSP | 8807 |
| RSN-2720 | GSAPTYGRAAEAANTTPAG LTAPATSGSETPGT | 8563 | RSC-2720 | GTAEAASASGTYGRAAEAA NTTPAGLTAPPGSP | 8808 |

TABLE 8b-continued

| Release Segment Sequences | | | | | |
|---|---|---|---|---|---|
| Name | Amino Acid Sequence | SEQ ID NO: | Name | Amino Acid Sequence | SEQ ID NO: |
| RSN-2721 | GSAPTTGRATEGANATPAEL TEPATSGSETPGT | 8564 | RSC-2721 | GTAEAASASGTTGRATEGA NATPAELTEPPGSP | 8809 |
| RSN-2722 | GSAPTVGRASEEANTTPASL TGPATSGSETPGT | 8565 | RSC-2722 | GTAEAASASGTVGRASEEA NTTPASLTGPPGSP | 8810 |
| RSN-2723 | GSAPTTGRAPEAANATPAPL TGPATSGSETPGT | 8566 | RSC-2723 | GTAEAASASGTTGRAPEAA NATPAPLTGPPGSP | 8811 |
| RSN-2724 | GSAPTWGRATEPANATPAP LTSPATSGSETPGT | 8567 | RSC-2724 | GTAEAASASGTWGRATEPA NATPAPLTSPPGSP | 8812 |
| RSN-2725 | GSAPTVGRASESANATPAEL TSPATSGSETPGT | 8568 | RSC-2725 | GTAEAASASGTVGRASESAN ATPAELTSPPGSP | 8813 |
| RSN-2726 | GSAPTVGRAPEGANSTPAGL TGPATSGSETPGT | 8569 | RSC-2726 | GTAEAASASGTVGRAPEGA NSTPAGLTGPPGSP | 8814 |
| RSN-2727 | GSAPTWGRATEAPNLEPATL TTPATSGSETPGT | 8570 | RSC-2727 | GTAEAASASGTWGRATEAP NLEPATLTTPPGSP | 8815 |
| RSN-2728 | GSAPTTGRATEAPNLTPAPL TEPATSGSETPGT | 8571 | RSC-2728 | GTAEAASASGTTGRATEAPN LTPAPLTEPPGSP | 8816 |
| RSN-2729 | GSAPTOGRATEAPNLSPAAL TSPATSGSETPGT | 8572 | RSC-2729 | GTAEAASASGTQGRATEAP NLSPAALTSPPGSP | 8817 |
| RSN-2730 | GSAPTOGRAAEAPNLTPATL TAPATSGSETPGT | 8573 | RSC-2730 | GTAEAASASGTQGRAAEAP NLTPATLTAPPGSP | 8818 |
| RSN-2731 | GSAPTSGRAPEATNLAPAPL TGPATSGSETPGT | 8574 | RSC-2731 | GTAEAASASGTSGRAPEATN LAPAPLTGPPGSP | 8819 |
| RSN-2732 | GSAPTQGRAAEAANLTPAG LTEPATSGSETPGT | 8575 | RSC-2732 | GTAEAASASGTQGRAAEAA NLTPAGLTEPPGSP | 8820 |
| RSN-2733 | GSAPTTGRAGSAPNLPPTGL TTPATSGSETPGT | 8576 | RSC-2733 | GTAEAASASGTTGRAGSAPN LPPTGLTTPPGSP | 8821 |
| RSN-2734 | GSAPTTGRAGGAENLPPEGL TAPATSGSETPGT | 8577 | RSC-2734 | GTAEAASASGTTGRAGGAE NLPPEGLTAPPGSP | 8822 |
| RSN-2735 | GSAPTTSRAGTATNLTPEGL TAPATSGSETPGT | 8578 | RSC-2735 | GTAEAASASGTTSRAGTATN LTPEGLTAPPGSP | 8823 |
| RSN-2736 | GSAPTTGRAGTATNLPPSGL TTPATSGSETPGT | 8579 | RSC-2736 | GTAEAASASGTTGRAGTAT NLPPSGLTTPPGSP | 8824 |
| RSN-2737 | GSAPTTARAGEAENLSPSGL TAPATSGSETPGT | 8580 | RSC-2737 | GTAEAASASGTTARAGEAE NLSPSGLTAPPGSP | 8825 |
| RSN-2738 | GSAPTTGRAGGAGNLAPGG LTEPATSGSETPGT | 8581 | RSC-2738 | GTAEAASASGTTGRAGGAG NLAPGGLTEPPGSP | 8826 |
| RSN-2739 | GSAPTTGRAGTATNLPPEGL TGPATSGSETPGT | 8582 | RSC-2739 | GTAEAASASGTTGRAGTAT NLPPEGLTGPPGSP | 8827 |
| RSN-2740 | GSAPTTGRAGGAANLAPTG LTEPATSGSETPGT | 8583 | RSC-2740 | GTAEAASASGTTGRAGGAA NLAPTGLTEPPGSP | 8828 |
| RSN-2741 | GSAPTTGRAGTAENLAPSGL TTPATSGSETPGT | 8584 | RSC-2741 | GTAEAASASGTTGRAGTAE NLAPSGLTTPPGSP | 8829 |
| RSN-2742 | GSAPTTGRAGSATNLGPGGL TGPATSGSETPGT | 8585 | RSC-2742 | GTAEAASASGTTGRAGSAT NLGPGGLTGPPGSP | 8830 |
| RSN-2743 | GSAPTTARAGGAENLTPAG LTEPATSGSETPGT | 8586 | RSC-2743 | GTAEAASASGTTARAGGAE NLTPAGLTEPPGSP | 8831 |
| RSN-2744 | GSAPTTARAGSAENLSPSGL TGPATSGSETPGT | 8587 | RSC-2744 | GTAEAASASGTTARAGSAE NLSPSGLTGPPGSP | 8832 |
| RSN-2745 | GSAPTTARAGGAGNLAPEG LTTPATSGSETPGT | 8588 | RSC-2745 | GTAEAASASGTTARAGGAG NLAPEGLTTPPGSP | 8833 |

TABLE 8b-continued

| Release Segment Sequences | | | | | |
|---|---|---|---|---|---|
| Name | Amino Acid Sequence | SEQ ID NO: | Name | Amino Acid Sequence | SEQ ID NO: |
| RSN-2746 | GSAPTTSRAGAAENLTPTGL TGPATSGSETPGT | 8589 | RSC-2746 | GTAEAASASGTTSRAGAAE NLTPTGLTGPPGSP | 8834 |
| RSN-2747 | GSAPTYGRTTTPGNEPPASL EAEATSGSETPGT | 8590 | RSC-2747 | GTAEAASASGTYGRTTTPGN EPPASLEAEPGSP | 8835 |
| RSN-2748 | GSAPTYSRGESGPNEPPPGL TGPATSGSETPGT | 8591 | RSC-2748 | GTAEAASASGTYSRGESGPN EPPPGLTGPPGSP | 8836 |
| RSN-2749 | GSAPAWGRTGASENETPAP LGGEATSGSETPGT | 8592 | RSC-2749 | GTAEAASASGAWGRTGASE NETPAPLGGEPGSP | 8837 |
| RSN-2750 | GSAPRWGRAETTPNTPPEGL ETEATSGSETPGT | 8593 | RSC-2750 | GTAEAASASGRWGRAETTP NTPPEGLETEPGSP | 8838 |
| RSN-2751 | GSAPESGRAANHTGAEPPEL GAGATSGSETPGT | 8594 | RSC-2751 | GTAEAASASGESGRAANHT GAEPPELGAGPGSP | 8839 |
| RSN-2754 | GSAPTTGRAGEAANLTPAG LTESATSGSETPGT | 8595 | RSC-2754 | GTAEAASASGTTGRAGEAA NLTPAGLTESPGSP | 8840 |
| RSN-2755 | GSAPTTGRAGEAANLTPAA LTESATSGSETPGT | 8596 | RSC-2755 | GTAEAASASGTTGRAGEAA NLTPAALTESPGSP | 8841 |
| RSN-2756 | GSAPTTGRAGEAANLTPAPL TESATSGSETPGT | 8597 | RSC-2756 | GTAEAASASGTTGRAGEAA NLTPAPLTESPGSP | 8842 |
| RSN-2757 | GSAPTTGRAGEAANLTPEPL TESATSGSETPGT | 8598 | RSC-2757 | GTAEAASASGTTGRAGEAA NLTPEPLTESPGSP | 8843 |
| RSN-2758 | GSAPTTGRAGEAANLTPAG LTGAATSGSETPGT | 8599 | RSC-2758 | GTAEAASASGTTGRAGEAA NLTPAGLTGAPGSP | 8844 |
| RSN-2759 | GSAPTTGRAGEAANLTPEGL TGAATSGSETPGT | 8600 | RSC-2759 | GTAEAASASGTTGRAGEAA NLTPEGLTGAPGSP | 8845 |
| RSN-2760 | GSAPTTGRAGEAANLTPEPL TGAATSGSETPGT | 8601 | RSC-2760 | GTAEAASASGTTGRAGEAA NLTPEPLTGAPGSP | 8846 |
| RSN-2761 | GSAPTTGRAGEAANLTPAG LTEAATSGSETPGT | 8602 | RSC-2761 | GTAEAASASGTTGRAGEAA NLTPAGLTEAPGSP | 8847 |
| RSN-2762 | GSAPTTGRAGEAANLTPEGL TEAATSGSETPGT | 8603 | RSC-2762 | GTAEAASASGTTGRAGEAA NLTPEGLTEAPGSP | 8848 |
| RSN-2763 | GSAPTTGRAGEAANLTPAPL TEAATSGSETPGT | 8604 | RSC-2763 | GTAEAASASGTTGRAGEAA NLTPAPLTEAPGSP | 8849 |
| RSN-2764 | GSAPTTGRAGEAANLTPEPL TEAATSGSETPGT | 8605 | RSC-2764 | GTAEAASASGTTGRAGEAA NLTPEPLTEAPGSP | 8850 |
| RSN-2765 | GSAPTTGRAGEAANLTPEPL TGPATSGSETPGT | 8606 | RSC-2765 | GTAEAASASGTTGRAGEAA NLTPEPLTGPPGSP | 8851 |
| RSN-2766 | GSAPTTGRAGEAANLTPAG LTGGATSGSETPGT | 8607 | RSC-2766 | GTAEAASASGTTGRAGEAA NLTPAGLTGGPGSP | 8852 |
| RSN-2767 | GSAPTTGRAGEAANLTPEGL TGGATSGSETPGT | 8608 | RSC-2767 | GTAEAASASGTTGRAGEAA NLTPEGLTGGPGSP | 8853 |
| RSN-2768 | GSAPTTGRAGEAANLTPEAL TGGATSGSETPGT | 8609 | RSC-2768 | GTAEAASASGTTGRAGEAA NLTPEALTGGPGSP | 8854 |
| RSN-2769 | GSAPTTGRAGEAANLTPEPL TGGATSGSETPGT | 8610 | RSC-2769 | GTAEAASASGTTGRAGEAA NLTPEPLTGGPGSP | 8855 |
| RSN-2770 | GSAPTTGRAGEAANLTPAG LTEGATSGSETPGT | 8611 | RSC-2770 | GTAEAASASGTTGRAGEAA NLTPAGLTEGPGSP | 8856 |
| RSN-2771 | GSAPTTGRAGEAANLTPEGL TEGATSGSETPGT | 8612 | RSC-2771 | GTAEAASASGTTGRAGEAA NLTPEGLTEGPGSP | 8857 |
| RSN-2772 | GSAPTTGRAGEAANLTPAPL TEGATSGSETPGT | 8613 | RSC-2772 | GTAEAASASGTTGRAGEAA NLTPAPLTEGPGSP | 8858 |

TABLE 8b-continued

| Release Segment Sequences | | | | | |
|---|---|---|---|---|---|
| Name | Amino Acid Sequence | SEQ ID NO: | Name | Amino Acid Sequence | SEQ ID NO: |
| RSN-2773 | GSAPTTGRAGEAANLTPEPL TEGATSGSETPGT | 8614 | RSC-2773 | GTAEAASASGTTGRAGEAA NLTPEPLTEGPGSP | 8859 |
| RSN-3047 | GSAPTTGRAGEAEGATSAG ATGPATSGSETPGT | 8538 | RSC-3047 | GTAEAASASGTTGRAGEAE GATSAGATGPPGSP | 8783 |
| RSN-2783 | GSAPEAGRSAEATSAGATGP ATSGSETPGT | 8615 | RSC-2783 | GTAEAASASGEAGRSAEATS AGATGPPGSP | 8860 |
| RSN-3107 | GSAPSASGTYSRGESGPGSP ATSGSETPGT | 8616 | RSC-3107 | GTAEAASASGSASGTYSRGE SGPGSPPGSP | 8861 |
| RSN-3103 | GSAPSASGEAGRTDTHPGSP ATSGSETPGT | 8617 | RSC-3103 | GTAEAASASGSASGEAGRTD THPGSPPGSP | 8862 |
| RSN-3102 | GSAPSASGEPGRAAEHPGSP ATSGSETPGT | 8618 | RSC-3102 | GTAEAASASGSASGEPGRAA EHPGSPPGSP | 8863 |
| RSN-3119 | GSAPSPAGESSRGTTIAGSPA TSGSETPGT | 8619 | RSC-3119 | GTAEAASASGSPAGESSRGT TIAGSPPGSP | 8864 |
| RSN-3043 | GSAPTTGEAGEAAGLTPAGL TGPATSGSETPGT | 8540 | RSC-3043 | GTAEAASASGTTGEAGEAA GLTPAGLTGPPGSP | 8785 |
| RSN-2789 | GSAPEAGESAGATPAGLTGP ATSGSETPGT | 8620 | RSC-2789 | GTAEAASASGEAGESAGATP AGLTGPPGSP | 8865 |
| RSN-3109 | GSAPSASGAPLELEAGPGSP ATSGSETPGT | 8621 | RSC-3109 | GTAEAASASGSASGAPLELE AGPGSPPGSP | 8866 |
| RSN-3110 | GSAPSASGEPPELGAGPGSP ATSGSETPGT | 8622 | RSC-3110 | GTAEAASASGSASGEPPELG AGPGSPPGSP | 8867 |
| RSN-3111 | GSAPSASGEPSGLTEGPGSP ATSGSETPGT | 8623 | RSC-3111 | GTAEAASASGSASGEPSGLT EGPGSPPGSP | 8868 |
| RSN-3112 | GSAPSASGTPAPLTEPPGSPA TSGSETPGT | 8624 | RSC-3112 | GTAEAASASGSASGTPAPLT EPPGSPPGSP | 8869 |
| RSN-3113 | GSAPSASGTPAELTEPPGSPA TSGSETPGT | 8625 | RSC-3113 | GTAEAASASGSASGTPAELT EPPGSPPGSP | 8870 |
| RSN-3114 | GSAPSASGPPPGLTGPPGSPA TSGSETPGT | 8626 | RSC-3114 | GTAEAASASGSASGPPPGLT GPPGSPPGSP | 8871 |
| RSN-3115 | GSAPSASGTPAPLGGEPGSP ATSGSETPGT | 8627 | RSC-3115 | GTAEAASASGSASGTPAPLG GEPGSPPGSP | 8872 |
| RSN-3125 | GSAPSPAGAPEGLTGPAGSP ATSGSETPGT | 8628 | RSC-3125 | GTAEAASASGSPAGAPEGLT GPAGSPPGSP | 8873 |
| RSN-3126 | GSAPSPAGPPEGLETEAGSP ATSGSETPGT | 8629 | RSC-3126 | GTAEAASASGSPAGPPEGLE TEAGSPPGSP | 8874 |
| RSN-3127 | GSAPSPTSGQGGLTGPGSEP ATSGSETPGT | 8630 | RSC-3127 | GTAEAASASGSPTSGQGGLT GPGSEPPGSP | 8875 |
| RSN-3131 | GSAPSESAPPEGLETESTEPA TSGSETPGT | 8631 | RSC-3131 | GTAEAASASGSESAPPEGLE TESTEPPGSP | 8876 |
| RSN-3132 | GSAPSEGSEPLELGAASETP ATSGSETPGT | 8632 | RSC-3132 | GTAEAASASGSEGSEPLELG AASETPPGSP | 8877 |
| RSN-3133 | GSAPSEGSGPAGLEAPSETP ATSGSETPGT | 8633 | RSC-3133 | GTAEAASASGSEGSGPAGLE APSETPPGSP | 8878 |
| RSN-3138 | GSAPSEPTPPASLEAEPGSPA TSGSETPGT | 8634 | RSC-3138 | GTAEAASASGSEPTPPASLE AEPGSPPGSP | 8879 |

In another aspect, the RS for incorporation into the human or animal recombinant polypeptides can be designed to be selectively sensitive in order to have different rates of cleavage and different cleavage efficiencies to the various proteases for which they are substrates. As a given protease can be found in different concentrations in diseased tissues, including but not limited to a tumor, a blood cancer, or an inflammatory tissue or site of inflammation, compared to healthy tissues or in the circulation, the disclosure provides RS that have had the individual amino acid sequences engineered to have a higher or lower cleavage efficiency for a given protease in order to ensure that the recombinant polypeptide is preferentially converted from the prodrug form to the active form (i.e., by the separation and release of the binding moieties and XTEN from the recombinant polypeptide after cleavage of the RS) when in proximity to the target cell or tissue and its co-localized proteases compared to the rate of cleavage of the RS in healthy tissue or the circulation wherein the released antibody fragment binding moieties have a greater ability to bind to ligands in the diseased tissues compared to the prodrug form that remains in circulation. By such selective designs, the therapeutic index of the resulting compositions can be improved, resulting in reduced side effects relative to convention therapeutics that do not incorporate such site-specific activation.

As used herein cleavage efficiency is defined as the $\log_2$ value of the ratio of the percentage of the test substrate comprising the RS cleaved to the percentage of the control substrate AC1611 cleaved when each is human or animal to the protease enzyme in biochemical assays (further detailed in the Examples) in which reaction in conducted wherein the initial substrate concentration is 6 μM, the reactions are incubated at 37° C. for 2 hours before being stopped by adding EDTA, with the amount of digestion products and uncleaved substrate analyzed by non-reducing SDS-PAGE to establish the ratio of the percentage cleaved. The cleavage efficiency is calculated as follows:

$$\mathrm{Log}_2\left(\frac{\%\ \text{Cleaved for substrate of interest}}{\%\ \text{cleaved for } AC1611 \text{ in the same experiment}}\right).$$

Thus, a cleavage efficiency of −1 means that the amount of test substrate cleaved was 50% compared to that of the control substrate, while a cleavage efficiency of +1 means that the amount of test substrate cleaved was 200% compared to that of the control substrate. A higher rate of cleavage by the test protease relative to the control would result in a higher cleavage efficiency, and a slower rate of cleavage by the test protease relative to the control would result in a lower cleavage efficiency. As detailed in the Examples, a control RS sequence AC1611 (RSR-1517), having the amino acid sequence EAGRSANHEPLGLVAT (SEQ ID NO: 8261), was established as having an appropriate baseline cleavage efficiency by the proteases legumain, MMP-2, MMP-7, MMP-9, MMP-14, uPA, and matriptase, when tested in in vitro biochemical assays for rates of cleavage by the individual proteases. By selective substitution of amino acids at individual locations in the RS peptides, libraries of RS were created and evaluated against the panel of the 7 proteases (detailed more fully in the Examples), resulting in profiles that were used to establish guidelines for appropriate amino acid substitutions in order to achieve RS with desired cleavage efficiencies. In making RS with desired cleavage efficiencies, substitutions using the hydrophilic amino acids A, E, G, P, S, and T are preferred, however other L-amino acids can be substituted at given positions in order to adjust the cleavage efficiency so long as the RS retains at least some susceptibility to cleavage by a protease. Conservative substitutions of amino acids in a peptide to retain or effect activity is well within the knowledge and capabilities of a person within skill in the art. In one embodiment, the disclosure provides RS in which the RS is cleaved by a protease selected from legumain, MMP-1, MMP-2, MMP-7, MMP-9, MMP-11, MMP-14, uPA, or matriptase with at least a 0.2 log 2, or 0.4 log 2, or 0.8 log 2, or 1.0 $\log_2$ higher cleavage efficiency in an in vitro biochemical competitive assay compared to the cleavage by the same protease of a control sequence RSR-1517 having the sequence EAGRSANHEPLGLVAT (SEQ ID NO: 8261). In another embodiment, the disclosure provides RS in which the RS is cleaved by a protease selected from legumain, MMP-1, MMP-2, MMP-7, MMP-9, MMP-11, MMP-14, uPA, or matriptase with at least a 0.2 log 2, or 0.4 log 2, or 0.8 log 2, or 1.0 log 2 lower cleavage efficiency in an in vitro biochemical competitive assay compared to the cleavage by the same protease of a control sequence RSR-1517 having the sequence EAGRSANHEPLGLVAT (SEQ ID NO: 8261). In one embodiment, the disclosure provides RS in which the rate of cleavage of the RS by a protease selected from legumain, MMP-1, MMP-2, MMP-7, MMP-9, MMP-11, MMP-14, uPA, or matriptase is at least 2-fold, or at least 4-fold, or at least 8 fold, or at least 16-fold faster compared to the control sequence RSR-1517 having the sequence EAGRSANHEPLGLVAT (SEQ ID NO: 8261). In another embodiment, the disclosure provides RS in which the rate of cleavage of the RS by a protease selected from legumain, MMP-1, MMP-2, MMP-7, MMP-9, MMP-11, MMP-14, uPA, or matriptase is at least 2-fold, or at least 4-fold, or at least 8 fold, or at least 16-fold slower compared to the control sequence RSR-1517 having the sequence EAGRSANHEPLGLVAT (SEQ ID NO: 8261).

In another aspect, the disclosure provides AAC comprising multiple RS wherein each RS sequence is selected from the group of sequences set forth in Table 8a and the RS are linked to each other by 1 to 6 amino acids selected from glycine, serine, alanine, and threonine. In one embodiment, the AAC comprises a first RS and a second RS different from the first RS wherein each RS sequence is selected from the group of sequences set forth in Table 8a and the RS are linked to each other by 1 to 6 amino acids selected from glycine, serine, alanine, and threonine. In another embodiment, the AAC comprises a first RS, a second RS different from the first RS, and a third RS different from the first and the second RS wherein each sequence is selected from the group of sequences set forth in Table 8a and the first and the second and the third RS are linked to each other by 1 to 6 amino acids selected from glycine, serine, alanine, and threonine. It is specifically intended that the multiple RS of the AAC can be concatenated to form a sequence that can be cleaved by multiple proteases at different rates or efficiency of cleavage. In another embodiment, the disclosure provides AAC comprising an RS1 and an RS2 selected from the group of sequences set forth in Tables 8a-8b and an XTEN 1 and XTEN 2, such as those described hereinabove or described elsewhere herein, wherein the RS1 is fused between the XTEN1 and the binding moieties and the RS2 is fused between the XTEN2 and the binding moieties. It is contemplated that such compositions would be more readily cleaved by diseased target tissues that express multiple proteases, compared with healthy tissues or when in the normal circulation, with the result that the resulting fragments bearing the binding moieties would more readily penetrate the target tissue; e.g., a tumor, and have an enhanced ability to bind and link the target cell and the effector cell (or just the target cell in the case of AAC designed with a single binding moiety.

The RS of the disclosure are useful for inclusion in recombinant polypeptides as therapeutics for treatment of cancers, autoimmune diseases, inflammatory diseases and other conditions where localized activation of the recombinant polypeptide is desirable. The human or animal compositions address an unmet need and are superior in one or more aspects including enhanced terminal half-life, targeted delivery, and improved therapeutic ratio with reduced toxicity to healthy tissues compared to conventional antibody therapeutics or bispecific antibody therapeutics that are active upon injection.

In some embodiments, the (fusion) polypeptide comprises a first release segment (RS1) located between the (first) XTEN and the biologically active polypeptide. In some embodiments, the polypeptide further comprises a second release segment (RS2) located between the biologically active polypeptide and the second XTEN. In some embodiments, RS1 and RS2 are identical in sequence. In some embodiments, RS1 and RS2 are not identical in sequence. In some embodiments, the RS1 comprises an amino acid sequence having at least 90%, 91%, 92%, 93%, 94%, 95%, 96%, 97%, 98%, 99% or 100% sequence identity to a sequence set forth in Tables 8a-8b. In some embodiments, the RS2 comprises an amino acid sequence having at least 90%, 91%, 92%, 93%, 94%, 95%, 96%, 97%, 98%, 99% or 100% sequence identity to a sequence set forth in Tables 8a-8b. In some embodiments, the RS1 and RS2 are each a substrate for cleavage by multiple proteases at one, two, or three cleavage sites within each release segment sequence.

Reference Fragment

In some embodiments, the (fusion) polypeptide further comprises one or more reference fragments releasable from the polypeptide upon digestion by the protease. In some embodiments, the one or more reference fragments each comprise a portion of the biologically active polypeptide. In some embodiments, the one or more reference fragments is a single reference fragment that differs in sequence and molecular weight from all other peptide fragments that are releasable from the polypeptide upon digestion of the polypeptide by the protease.

Polypeptide Mixture

Disclosed herein includes a mixture comprising a plurality of polypeptides of varying length; the mixture comprising a first set of polypeptides and a second set of polypeptides. In some embodiments, each polypeptide of the first set of polypeptides comprises a barcode fragment that (a) is releasable from the polypeptide by digestion with a protease and (b) has a sequence and molecular weight that differs from the sequence and molecular weight of all other fragments that are releasable from the first set of polypeptides. In some embodiments, the second set of polypeptides lack the barcode fragment of the first set of polypeptides. In some embodiments, both the first set of polypeptides and the second set of polypeptides each comprise a reference fragment that (a) is common to the first set of polypeptides and the second set of polypeptides and (b) releasable by digestion with the protease. In some embodiments, the ratio of the first set of polypeptides to polypeptides comprising the reference fragment is greater than 0.70. In some embodiments, the ratio of the first set of polypeptides to polypeptides comprising the reference fragment is greater than 0.8, 0.9, 0.95, or 0.98. In some embodiments, the reference fragment occurs no more than once in each polypeptide of the first set of polypeptides and the second set of polypeptides. In some embodiments, the protease is a protease that cleaves on the C-terminal side of glutamic acid residues. In some embodiments, the protease is a Glu-C protease. In some embodiments, the protease is not trypsin. In some embodiments, the polypeptides of varying lengths comprise polypeptides comprising at least one extended recombinant polypeptide (XTEN), such as any described hereinabove or described anywhere else herein. In some embodiments, the first set of polypeptides comprises a full-length polypeptide, wherein the barcode fragment is a portion of the full-length polypeptide. In some embodiments, the full-length polypeptide is a (fusion) polypeptide, such as any described hereinabove or described anywhere else herein. In some embodiments, the barcode fragment lacks (does not comprise) both the N-terminal amino acid and C-terminal amino acid of the full-length polypeptide. In some embodiments, the mixture of polypeptides of varying lengths differ from one another due to N-terminal truncation, C-terminal truncation, or both N- and C-terminal truncation of a full-length polypeptide. In some embodiments, the first set of polypeptides and the second set of polypeptides can differ in one or more pharmacological properties. Non-limiting exemplary properties include.

Method of Polypeptide Characterization

Disclosed herein includes a method for assessing, in a mixture comprising polypeptides of varying length, a relative amount of a first set of polypeptides in the mixture to a second set of polypeptides in the mixture, wherein (1) each polypeptide of the first set of polypeptides shares a barcode fragment that occurs once and only once in the polypeptide and (2) each polypeptide of the second set of polypeptides lacks the barcode fragment that is shared by polypeptides of the first set, wherein individual polypeptides of both the first of polypeptides and the second set of polypeptides each comprises a reference fragment. The method can comprise contacting the mixture with a protease to produce a plurality of proteolytic fragments that result from cleavage of the first set of polypeptides and the second set of polypeptides, wherein the plurality of proteolytic fragments comprises a plurality of reference fragments, and a plurality of barcode fragments. The method can further comprise determining a ratio of the amount of barcode fragments to the amount of reference fragments, thereby assessing the relative amounts of the first set of polypeptides to the second set of polypeptides. In some embodiments, the barcode fragment occurs no more than once in each polypeptide of the first set of polypeptides. In some embodiments, the reference fragment occurs no more than once in each polypeptide of the first set of polypeptides and the second set of polypeptides. In some embodiments, the plurality of proteolytic fragments comprises a plurality of reference fragments, and a plurality of barcode fragments. In some embodiments, the protease cleaves the first and second sets of polypeptides (or the polypeptides of varying length) on the C-terminal side of glutamic acid residues that are not followed by a proline residue. In some embodiments, the protease is a Glu-C protease. In some embodiments, the protease is not trypsin. In some embodiments, the step of determining a ratio of the amount of barcode fragments to the amount of reference fragments comprises quantifying barcode fragments and reference fragments from the mixture after it has been contacted with the protease. In some embodiments, the barcode fragments and the reference fragments are identified based on their respective masses. In some embodiments, the barcode fragments and the reference fragments are identified via mass spectrometry. In some embodiments, the barcode fragments and reference fragments are identified via liquid chromatography-mass spectrometry (LC-MS). In some embodiments, the step of determining a ratio of the barcode fragments to the reference fragments comprises isobaric labeling. In some embodiments, the step of determining a ratio of the barcode fragments to the reference fragments comprises spiking the mixture with one or both of an isotope-labeled reference fragment and an isotope labeled barcode fragment. In some embodiments, the polypeptides of varying lengths comprise polypeptides that comprise at least one extended recombinant polypeptide (XTEN), as described hereinabove or described anywhere else herein. In some embodiments, the XTEN is characterized in that (i) it comprises at least 150 amino acids; (ii) at least 90% of the amino acid residues of the XTEN are selected from glycine (G), alanine (A), serine (S), threonine (T), glutamate (E) and proline (P); and (iii) it comprises at least 4 different types of amino acids selected from G, A, S, T, E, and P. In some embodiments, the barcode fragment, when present, is a portion of the XTEN. In some embodiments, the mixture of polypeptides of varying lengths comprises a polypeptide as any described hereinabove or described anywhere else herein. In some embodiments, the polypeptides of varying length comprise a full-length polypeptide and truncated fragments thereof. In some embodiments, the polypeptides of varying length consist essentially of the full-length polypeptide and truncated fragments thereof. In some embodiments, the mixture of polypeptides of varying lengths differ from one another due to N-terminal truncation, C-terminal truncation, or both N- and C-terminal truncation of a full-length polypeptide. In some embodiments, the full-length polypeptide is a polypeptide as described hereinabove or described anywhere else herein. In some embodiments, the ratio of the amount of barcode fragments to reference fragments is greater than 0.5, 0.6, 0.7, 0.8, 0.9, 0.95, 0.98, or 0.99.

Isobaric Labeling-Based Quantification of Peptides

In some embodiments, isobaric labeling can be used for determining a ratio of the barcode fragments to the reference fragments. One of ordinary skill will understand that isobaric labeling is a mass spectrometry strategy used in quantitative proteomics, wherein peptides or proteins (or portions thereof) are labeled with various chemical groups that are isobaric (identical in mass) but vary in terms of distribution of heavy isotopes around their structure. These tags, commonly referred to as tandem mass tags, are designed so that the mass tag is cleaved at a specific linker region upon high-energy collision-induced dissociation (CID) during tandem mass spectrometry, thereby yielding reporter ions of different masses. One of ordinary skill will understand that one of the most common isobaric tags are amine-reactive tags.

The enhanced ability to detect and quantify truncation products (e.g., via isobaric labeling) can generate knowledge than can aid in designing manufacturing processes to include purification steps to minimize the presence of unwanted variants in the purified drug substance/product.

Recombinant Production

The disclosure herein includes a nucleic acid. The nucleic acid can comprise a polynucleotide (or polynucleotide sequence) encoding a (fusion) polypeptide, such as any described hereinabove or described anywhere else herein; or the nucleic acid can comprise the reverse complement of such a polynucleotide (or polynucleotide sequence).

The disclosure herein includes an expression vector that comprises a polynucleotide sequence, such as any described in the preceding paragraph, and a regulatory sequence operably linked to the polynucleotide sequence.

The disclosure herein includes a host cell comprising an expression vector, such as described in the preceding paragraph. In some embodiments, the host cell is a prokaryote. In some embodiments, the host cell is *E. coli*. In some embodiments, the host cell is a mammalian cell.

In another aspect, the disclosure provides methods of manufacturing the human or animal compositions. In one embodiment, the method comprises culturing a host cell comprising a nucleic acid construct that encodes a polypeptide or an XTEN-containing composition of any of the embodiments described herein under conditions that promote the expression of the polypeptide or BPXTEN fusion polypeptide, followed by recovery of the polypeptide or BPXTEN fusion polypeptide using standard purification methods (e.g., column chromatography, HPLC, and the like) wherein the composition is recovered wherein at least 70%, or at least 80%, or at least 90%, or at least 95%, or at least 97%, or at least 99% of the binding fragments of the expressed polypeptide or BPXTEN fusion polypeptide are correctly folded. In another embodiment of the method of making, the expressed polypeptide or BPXTEN fusion polypeptide is recovered in which at least or at least 90%, or at least 95%, or at least 97%, or at least 99% of the polypeptide or BPXTEN fusion polypeptide is recovered in monomeric, soluble form.

In another aspect, the disclosure relates to methods of making the polypeptide and BPXTEN fusion polypeptide at high fermentation expression levels of functional protein using an *E. coli* or mammalian host cell, as well as providing expression vectors encoding the constructs useful in methods to produce the cytotoxically active polypeptide construct compositions at high expression levels. In one embodiment, the method comprises the steps of 1) preparing the polynucleotide encoding the polypeptides of any of the embodiments disclosed herein, 2) cloning the polynucleotide into an expression vector, which can be a plasmid or other vector under control of appropriate transcription and translation sequences for high level protein expression in a biological system, 3) transforming an appropriate host cell with the expression vector, and 4) culturing the host cell in conventional nutrient media under conditions suitable for the expression of the polypeptide composition. Where desired, the host cell is *E. coli*. By the method, the expression of the polypeptide results in fermentation titers of at least 0.05 g/L, or at least 0.1 g/L, or at least 0.2 g/L, or at least 0.3 g/L, or at least 0.5 g/L, or at least 0.6 g/L, or at least 0.7 g/L, or at least 0.8 g/L, or at least 0.9 g/L, or at least 1 g/L, or at least 2 g/L, or at least 3 g/L, or at least 4 g/L, or at least 5 g/L of the expression product of the host cell and wherein at least 70%, or at least 80%, or at least 90%, or at least 95%, or at least 97%, or at least 99% of the expressed protein are correctly folded. As used herein, the term "correctly folded" means that the antigen binding fragments component of the composition have the ability to specifically bind its target ligand.

In another embodiment, the disclosure provides a method for producing a polypeptide or BPXTEN fusion polypeptide, the method comprising culturing in a fermentation reaction a host cell that comprises a vector encoding a polypeptide comprising the polypeptide or BPXTEN fusion polypeptide under conditions effective to express the polypeptide product at a concentration of more than about 10 milligrams/gram of dry weight host cell (mg/g), or at least about 250 mg/g, or about 300 mg/g, or about 350 mg/g, or about 400 mg/g, or about 450 mg/g, or about 500 mg/g of said polypeptide when the fermentation reaction reaches an optical density of at least 130 at a wavelength of 600 nm, and wherein the antigen binding fragments of the expressed protein are correctly folded. In another embodiment, the disclosure provides a method for producing a polypeptide or BPXTEN fusion polypeptide, the method comprising culturing in a fermentation reaction a host cell that comprises a vector encoding the composition under conditions effective to express the polypeptide product at a concentration of more than about 10 milligrams/gram of dry weight host cell (mg/g), or at least about 250 mg/g, or about 300 mg/g, or about 350 mg/g, or about 400 mg/g, or about 450 mg/g, or about 500 mg/g of said polypeptide when the fermentation reaction reaches an optical density of at least 130 at a wavelength of 600 nm, and wherein the expressed polypeptide product is soluble.

Pharmaceutical Composition

Disclosed herein includes a pharmaceutical composition comprising a BPXTEN polypeptide, such as any described hereinabove or described anywhere else herein, and one or more pharmaceutically acceptable excipients. In some embodiments, the pharmaceutical composition is formulated for intradermal, subcutaneous, intravenous, intra-arterial, intraabdominal, intraperitoneal, intravitreal, intrathecal, or intramuscular administration. In some embodiments, the pharmaceutical composition is in a liquid form. In some embodiments, the pharmaceutical composition is in a device that is implanted into the eye or another body part. In some embodiments, the pharmaceutical composition is in a pre-filled syringe for a single injection. In some embodiments, the pharmaceutical composition is formulated as a lyophilized powder to be reconstituted prior to administration.

In some embodiments, the dose is administered intradermally, subcutaneously, intravenously, intravitreally (or otherwise injected into the eye), intra-arterially, intra-abdominally, intraperitoneally, intrathecally, or intramuscularly. In some embodiments, the pharmaceutical composition is administered using a device implanted into the eye or other body part. In some embodiments, the human or animal is a mouse, rat, monkey, or human.

The pharmaceutical compositions can be administered for therapy by any suitable route In addition, the pharmaceutical compositions can also contain other pharmaceutically active compounds or a plurality of compounds of the invention.

In some embodiments, the pharmaceutical composition can be administered at a therapeutically effective dose. In some cases of the foregoing, the therapeutically effective dose results in a gain in time spent within a therapeutic window for the fusion protein compared to the corresponding BP of the fusion protein not linked to the fusion protein and administered at a comparable dose to a human or animal.

In another embodiment, invention provides a method of treating a disease, disorder or condition, comprising administering the pharmaceutical composition described above to a human or animal using multiple consecutive doses of the pharmaceutical composition administered using a therapeutically effective dose regimen BPXTEN polypeptides of the present invention can be formulated according to known methods to prepare pharmaceutically useful compositions, whereby the polypeptide is combined in admixture with a pharmaceutically acceptable carrier vehicle, such as aqueous solutions or buffers, pharmaceutically acceptable suspensions and emulsions. Therapeutic formulations are prepared for storage by mixing the active ingredient having the desired degree of purity with optional physiologically acceptable carriers, excipients or stabilizers, as described in Remington's Pharmaceutical Sciences 16th edition, Osol, A. Ed. (1980).

Pharmaceutical Kits

In another aspect, the invention provides a kit to facilitate the use of the BPXTEN polypeptides. In one embodiment, the kit comprises, in at least a first container: (a) an amount of a BPXTEN fusion protein composition sufficient to treat a disease, condition or disorder upon administration to a human or animal in need thereof; and (b) an amount of a pharmaceutically acceptable carrier; together in a formulation ready for injection or for reconstitution with sterile water, buffer, or dextrose; together with a label identifying the BPXTEN drug and storage and handling conditions, and a sheet of the approved indications for the drug, instructions for the reconstitution and/or administration of the BPXTEN drug for the use for the prevention and/or treatment of an approved indication, appropriate dosage and safety information, and information identifying the lot and expiration of the drug. In another embodiment of the foregoing, the kit can comprise a second container that can carry a suitable diluent for the BPXTEN composition, which provides the user with the appropriate concentration of BPXTEN to be delivered to the human or animal.

Method of Treatment

Disclosed herein includes use of a polypeptide, such as any described hereinabove or described anywhere else herein, in the preparation of a medicament for the treatment of a disease in a human or animal. In some embodiments, the particular disease to be treated depends on the choice of the biologically active proteins. In some embodiments, the disease is cancer.

Disclosed herein includes a method of treating a disease in a human or animal, the method comprising administering to the human or animal in need thereof one or more therapeutically effective doses of the pharmaceutical composition, such as any described hereinabove or described anywhere else herein. In some embodiments, the disease is cancer. In some embodiments, the pharmaceutical composition is administered to the human or animal as one or more therapeutically effective doses administered according to a dosage regimen. In some embodiments, the human or animal is a mouse, rat, monkey, or human.

The following are examples of compositions and evaluations of compositions of the disclosure. It is understood that various other embodiments can be practiced, given the general description provided above.

EXAMPLES

Example 1. Design of Barcoded XTEN by Minimal Mutations from General-Purpose XTEN This example illustrates an exemplary design approach to barcoded XTEN polypeptide by making minimal mutation (s) of the amino acid sequence of a general-purpose XTEN polypeptide (such as one of Table 3b hereinabove). The relevant criteria for performing minimal mutation(s) include one or more of the following: (a) to minimize the sequence change of the corresponding XTEN polypeptide; (b) to minimize the amino acid composition change in the corresponding XTEN polypeptide; (c) to substantially maintain the net charge in the corresponding XTEN polypeptide; (d) to substantially maintain the low immunogenicity of the corresponding XTEN polypeptide; (e) to substantially maintain the pharmacokinetic properties afforded by the XTEN polypeptide.

For example, barcoded XTENs were constructed by performing one or more mutations comprising deletion of a glutamic acid residue, insertion of a glutamic acid residue, substitution of a glutamic acid residue, or substitution for a glutamic acid residue, or any combination thereof to the general-purpose XTENs in Table 9.

The in silico analysis takes into consideration that, with respect to an XTEN polypeptide having consecutive glutamic acid residues (e.g., "EE"), GluC can cleave after either one of the glutamic acid residues. As shown in the results summarized below in Table 10, a 10-mer peptide sequence "TPGTSTEPSE (SEQ ID NO: 8880)" and a 14-mer peptide sequence "GSAPGSEPATSGSE (SEQ ID NO: 8881)" each occur once and only once in the longer XTEN864, while all other peptide sequences occur two or more times in

TABLE 9

Four general-purpose XTENs used for engineering of barcoded XTEN Polypeptides

| SEQ ID NO. | XTEN Name | Amino Acid Sequence |
|---|---|---|
| 676 | AE144 | GSEPATSGSETPGTSESATPESGPGSEPATSGSETPGSPAGSPTSTEEGTSTEPSEG SAPGSEPATSGSETPGSEPATSGSETPGSEPATSGSETPGTSTEPSEGSAPGTSESA TPESGPGSEPATSGSETPGTSTEPSEGSAP |
| 686 | AE288_1 | GTSESATPESGPGSEPATSGSETPGTSESATPESGPGSEPATSGSETPGTSESATPE SGPGTSTEPSEGSAPGSPAGSPTSTEEGTSESATPESGPGSEPATSGSETPGTSESA TPESGPGSPAGSPTSTEEGSPAGSPTSTEEGTSTEPSEGSAPGTSESATPESGPGTS ESATPESGPGTSESATPESGPGSEPATSGSETPGSEPATSGSETPGSPAGSPTSTEE GTSTEPSEGSAPGTSTEPSEGSAPGSEPATSGSETPGTSESATPESGPGTSTEPSEG SAP |
| 688 | AE576 | GSPAGSPTSTEEGTSESATPESGPGTSTEPSEGSAPGSPAGSPTSTEEGTSTEPSEG SAPGTSTEPSEGSAPGTSESATPESGPGSEPATSGSETPGSEPATSGSETPGSPAGS PTSTEEGTSESATPESGPGTSTEPSEGSAPGTSTEPSEGSAPGSPAGSPTSTEEGTS TEPSEGSAPGTSTEPSEGSAPGTSESATPESGPGTSTEPSEGSAPGTSESATPESGP GSEPATSGSETPGTSTEPSEGSAPGTSTEPSEGSAPGTSESATPESGPGTSESATPE SGPGSPAGSPTSTEEGTSESATPESGPGSEPATSGSETPGTSESATPESGPGTSTEP SEGSAPGTSTEPSEGSAPGTSTEPSEGSAPGTSTEPSEGSAPGTSTEPSEGSAPGTS TEPSEGSAPGSPAGSPTSTEEGTSTEPSEGSAPGTSESATPESGPGSEPATSGSETP GTSESATPESGPGSEPATSGSETPGTSESATPESGPGTSTEPSEGSAPGTSESATPE SGPGSPAGSPTSTEEGSPAGSPTSTEEGSPAGSPTSTEEGTSESATPESGPGTSTEP SEGSAP |
| 690 | AE864 | GSPAGSPTSTEEGTSESATPESGPGTSTEPSEGSAPGSPAGSPTSTEEGTSTEPSEG SAPGTSTEPSEGSAPGTSESATPESGPGSEPATSGSETPGSEPATSGSETPGSPAGS PTSTEEGTSESATPESGPGTSTEPSEGSAPGTSTEPSEGSAPGSPAGSPTSTEEGTS TEPSEGSAPGTSTEPSEGSAPGTSESATPESGPGTSTEPSEGSAPGTSESATPESGP GSEPATSGSETPGTSTEPSEGSAPGTSTEPSEGSAPGTSESATPESGPGTSESATPE SGPGSPAGSPTSTEEGTSESATPESGPGSEPATSGSETPGTSESATPESGPGTSTEP SEGSAPGTSTEPSEGSAPGTSTEPSEGSAPGTSTEPSEGSAPGTSTEPSEGSAPGTS TEPSEGSAPGSPAGSPTSTEEGTSTEPSEGSAPGTSESATPESGPGSEPATSGSETP GTSESATPESGPGSEPATSGSETPGTSESATPESGPGTSTEPSEGSAPGTSESATPE SGPGSPAGSPTSTEEGSPAGSPTSTEEGSPAGSPTSTEEGTSESATPESGPGTSTEP SEGSAPGTSESATPESGPGSEPATSGSETPGTSESATPESGPGSEPATSGSETPGTS ESATPESGPGTSTEPSEGSAPGSPAGSPTSTEEGTSESATPESGPGSEPATSGSETP GTSESATPESGPGSPAGSPTSTEEGSPAGSPTSTEEGTSTEPSEGSAPGTSESATPE SGPGTSESATPESGPGTSESATPESGPGSEPATSGSETPGSEPATSGSETPGSPAGS PTSTEEGTSTEPSEGSAPGTSTEPSEGSAPGSEPATSGSETPGTSESATPESGPGTS TEPSEGSAP |

Example 2. Sequence Analysis of Barcoded XTEN Polypeptides and Selection Thereof for Fusion to a Biologically-Active Polypeptide ("BP")

This example illustrates the design and selection of barcoded XTEN polypeptide (and the assembly of more than one barcoded XTENs into a set) for fusion to a biologically-active polypeptide. Depending on the location of the barcode fragment(s) within the XTEN(s) and the manner in which the XTEN polypeptide(s) is/are fused to a biologically-active protein to form an XTEN polypeptide-containing construct (e.g., an XTENylated protease-activated T-cell engager (XPAT)), the barcode fragment(s) can indicate truncation(s) of the XTEN polypeptide.

In silico GluC digestion analysis was performed on two exemplary XTEN polypeptides (XTEN864 and XTEN288_1) to quantify the releasable peptide fragments upon complete GluC digestion of the XTEN polypeptide.

XTEN864. And the 14-mer peptide sequence "GSAPGSEPATSGSE (SEQ ID NO: 8881)" also occurs once and only once in the shorter XTEN2881.

The uniqueness of a candidate barcode is assessed in relation to all other peptide fragments releasable from the XTEN polypeptide-containing construct. Accordingly, a barcode sequence in one XTEN polypeptide cannot occur anywhere else in the XTEN polypeptide-containing construct, including any other XTEN polypeptide contained therewithin, any biologically-active protein contained therewithin, or any connection between neighboring components thereof. For example, Table 11 shows a peptide "uniqueness" table for the set of two XTEN polypeptides. Due to its presence in both XTEN864 and XTEN288, the 14-mer peptide sequence "GSAPGSEPATSGSE (SEQ ID NO: 8881" is not unique to the set of XTEN polypeptides comprising both XTEN864 and XTEN288 and, thus, cannot be used as a barcode for detecting truncations in polypeptide products that contain both of the two XTEN polypeptides.

The selection of a barcode (or a set of barcodes) can further involve identifying and determining the proper location(s) or position(s) of the candidate barcode(s) within the XTEN polypeptide. The location or position of a candidate barcode can be associated with pharmacologically relevant information of the XTEN polypeptide (and the XTEN polypeptide-containing construct as a whole), such as truncation of the XTEN polypeptide beyond a critical length and/or deletion(s) in the XTEN polypeptide. The 10mer peptide "TPGTSTEPSE (SEQ ID NO: 8880)" could serve as a suitable barcode fragment if XTEN864 is placed at the N-terminus of the XTEN polypeptide-containing product and if the truncation of 238 amino acids from the N-terminus of the product does not significantly impact the pharmacological properties of the product.

TABLE 10

Representative XTEN sequences for GluC digestion analysis

| Exemplary XTEN | Amino acid sequence | SEQ ID NO: |
|---|---|---|
| XTEN864 | GSPAGSPTSTEEGTSESATPESGPGTSTEPSEGSAPGSPAGSPTSTEEGTSTEPSEGSAP<br>GTSTEPSEGSAPGTSESATPESGPGSEPATSGSETPGSEPATSGSETPGSPAGSPTSTEE<br>GTSESATPESGPGTSTEPSEGSAPGTSTEPSEGSAPGSPAGSPTSTEEGTSTEPSEGSAP<br>GTSTEPSEGSAPGTSESATPESGPGTSTEPSEGSAPGTSESATPESGPGSEPATSGSE**TP**<br>**GTSTEPSE**GSAPGTSTEPSEGSAPGTSESATPESGPGTSESATPESGPGSPAGSPTSTEE<br>GTSESATPESGPGSEPATSGSETPGTSESATPESGPGTSTEPSEGSAPGTSTEPSEGSAP<br>GTSTEPSEGSAPGTSTEPSEGSAPGTSTEPSEGSAPGTSTEPSEGSAPGSPAGSPTSTEE<br>GTSTEPSEGSAPGTSESATPESGPGSEPATSGSETPGTSESATPESGPGSEPATSGSETP<br>GTSESATPESGPGTSTEPSEGSAPGTSESATPESGPGSPAGSPTSTEEGSPAGSPTSTEE<br>GSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEE<br>GTSESATPESGPGSEPATSGSETPGTSESATPESGPGSPAGSPTSTEEGSPAGSPTSTEE<br>GTSTEPSEGSAPGTSESATPESGPGTSESATPESGPGTSESATPESGPGSEPATSGSETP<br>GSEPATSGSETPGSPAGSPTSTEEGTSTEPSEGSAPGTSTEPSE**GSAPGSEPATSGSE**TP<br>GTSESATPESGPGTSTEPSEGSAP | 8882 |
| AE288_1 | GTSESATPESGPGSEPATSGSETPGTSESATPESGPGSEPATSGSETPGTSESATPESGP<br>GTSTEPSEGSAPGSPAGSPTSTEEGTSESATPESGPGSEPATSGSETPGTSESATPESGP<br>GSPAGSPTSTEEGSPAGSPTSTEEGTSTEPSEGSAPGTSESATPESGPGTSESATPESGP<br>GTSESATPESGPGSEPATSGSETPGSEPATSGSETPGSPAGSPTSTEEGTSTEPSEGSAP<br>GTSTEPSE**GSAPGSEPATSGSE**TPGTSESATPESGPGTSTEPSEGSAP | 8883 |

TABLE 11

Peptide "uniqueness" analysis

| Peptide fragments | SEQ ID NO: | XTEN AE288_1 | XTEN864 | Both |
|---|---|---|---|---|
| SATPE | 8884 | 9 | 23 | 32 |
| SGPGSEPATSGSE | 8885 | 4 | 9 | 13 |
| GSAPGTSTEPSE | 8886 | 1 | 10 | 11 |
| TPGTSE | 8887 | 4 | 7 | 11 |
| SGPGTSTEPSE | 8888 | 2 | 8 | 10 |
| GSAPGTSE | 8889 | 1 | 8 | 9 |
| GTSTEPSE | 8890 | 2 | 5 | 7 |
| GSAPGSPAGSPTSTEE | 8891 | 1 | 4 | 5 |
| GSPAGSPTSTEE | 186 | 1 | 4 | 5 |
| SGPGTSE | 8892 | 2 | 3 | 5 |
| SGPGSPAGSPTSTEE | 8893 | 1 | 3 | 4 |
| TPGSEPATSGSE | 8894 | 1 | 2 | 3 |
| TPGSPAGSPTSTEE | 8895 | 1 | 2 | 3 |

TABLE 11-continued

| Peptide "uniqueness" analysis | | | | |
|---|---|---|---|---|
| Peptide fragments | SEQ ID NO: | XTEN AE288_1 | XTEN864 | Both |
| GSAPGSEPATSGSE | 8881 | 1 | 1 | 2 |
| TPGTSTEPSE | 8880 | | 1 | 1 |

All underlined sequences produce unique GluC peptides
Non-XTEN core underlined and italic
Barcode peptides are bold Exemplary barcode peptide sequences are illustrated below in Table 12. These barcode sequences should be flanked according to the structural formula (I):

AAA-Glu-Barcode Peptide-BBB, wherein "AAA" represents Gly, Ala, Ser, Thr or Pro and "BBB" represent Gly, Ala, Ser, or Thr configured to facilitate efficient release of the barcode peptide by GluC digestion. Notably, the insertion of each barcode peptide in the XTEN can result in additional unique sequences directly preceding or following the inserted barcode peptides.

TABLE 12

| List of suitable barcode peptides | | | | |
|---|---|---|---|---|
| Candidate Barcode Peptide(s) | SEQ ID NO: | Occurrence in XTEN864 | Occurrence in XTEN288_1 | Occurrence in XTEN1152 |
| SPATSGSTPE | 8020 | 0 | 0 | |
| GSAPATSE | 8021 | 0 | 0 | 0 |
| GSAPGTATE | 8022 | 0 | 0 | 0 |
| GSAPGTE | 8023 | 0 | 0 | 0 |
| PATSGPTE | 8024 | 0 | 0 | 0 |
| SASPE | 8025 | 0 | 0 | 0 |
| PATSGSTE | 8026 | 0 | 0 | 0 |
| GSAPGTSAE | 8027 | | | |
| SATSGSE | 8028 | 0 | 0 | 0 |
| SGPGSTPAE | 8029 | 0 | 0 | |
| SGSE | 8030 | 0 | | |

BPXTEN, a barcoded XTEN polypeptide (SEQ ID No. 8014) is fused at the N-terminus of the BP, and another barcoded XTEN polypeptide (SEQ ID No. 8015) is fused at the C-terminus of the BP. In the reference BPXTEN, a "Ref-N" XTEN polypeptide (SEQ ID No. 8896) is fused at the N-terminus of the BP, and a "Ref-C" XTEN polypeptide (SEQ ID No. 8897) is fused at the C-terminus of the BP. The "Ref-N" XTEN polypeptide (SEQ ID No. 8896) is comparable in length to the barcoded XTEN polypeptide SEQ ID No. 8014; and the "Ref-C" XTEN polypeptide (SEQ ID No. 8897) is comparable in length to the barcoded XTEN polypeptide SEQ ID No. 8015. The barcoded and reference BPXTENs each contain a reference sequence in the BP component. The reference sequence is unique and differs in molecular weight from all other peptide fragments that are releasable from the corresponding BPXTEN upon complete digestion by GluC protease (e.g., according to Example 5). The uniqueness of the reference sequence is assessed in relation to all other peptide fragments releasable from the BPXTEN construct.

Example 3: Design and Selection of XTEN(s) in Full Sequence XTENylated Polypeptide Constructs This example illustrates the design of a full-sequence polypeptide construct, containing two XTEN polypeptides, one at the N-terminus and the other at the C-terminus.

Table 13 below illustrates XTEN polypeptides used in a representative barcoded BPXTEN (containing barcoded XTEN polypeptides at both the N- and C-termini) and a reference BPXTEN (containing general-purpose XTENs at both the N- and C-termini). In the representative barcoded

TABLE 13

Representative sets of N- and C-terminal XTENs used in full-length BPXTEN constructs

| SEQ ID NO. | XTEN Type | Amino Acid Sequence | Total # of AAs |
|---|---|---|---|
| 8014 (from Table 3a) | N-terminal XTEN | SPAGSPTSTESGTSESATPESGPGTSTEPSEGSAPGTSESATPESGPGSEPAT<br>SGSETPGTSESATPE**SGPGSTPAESGSE**TPGTSESATPESGPGTSTEPSEGS<br>APGSPAGSPTSTEEGTSESATPESGPGSEPATSGSETPGTSESATPESGPGSP<br>AGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEE<br>GTSTEPSEGSAPGTSTEPSEGSAPGGSAP | 292 |
| 8015 (from Table 3a) | C-terminal XTEN | PGSPAGSPTSTEEGTSESATPESGPGSEPATSGSETPGTSESATPESGPGTST<br>EPSEGSAPGTSTEPSEGSAPGTSTEPSEGSAPGTSTEPSEGSAPGTSTEPSEG<br>SAPGTSTEPSEGSAPGSPAGSPTSTEEGTSTEPSEGSAPGTSESATPESGPGS<br>EPATSGSETPGTSESATPESGPGSEPATSGSETPGTSESATPESGPGTSTEPS<br>EGSAPGTSESATPESGPGSPAGSPTSTEEGSPAGSPTSTEEGSPAGSPTSTE<br>EGTSESATPESGPGTSTEPSEGSAPGTSESATPESGPGSEPATSGSETPGTSE<br>SATPESGPGSEPATSGSETPGTSESATPESGPGTSTEPSEGSAPGSPAGSPTS<br>TEEGTSESATPESGPGSEPATSGSETPGTSESATPESGPGSPAGSPTSTEEGS<br>PAGSPTSTEEGTSTEPSEGSAPGTSESATPESGPGTSESATPESGPGTSESAT<br>PESGPGSEPATSGSETPGSEPATSGSETPGSPAGSPTSTEEGTSTEPSE**GSAP**<br>**GTE**STPSEGSAPGSEPATSGSETPGTSESATPESGPGTSTEPSEGSAPGEPE<br>A | 582 |
| 8896 Ref-N | N-terminal XTEN | SPAGSPTSTEEGTSESATPESGPGTSTEPSEGSAPGTSESATPESGPGSEPAT<br>SGSETPGTSESATPESGPGSEPATSGSETPGTSESATPESGPGTSTEPSEGSA<br>PGSPAGSPTSTEEGTSESATPESGPGSEPATSGSETPGTSESATPESGPGSPA<br>GSPTSTEEGSPAGSPTSTEEGTSTEPSEGSAPGTSESATPESGPGTSESATPE<br>SGPGTSESATPESGPGSEPATSGSETPGSEPATSGSETPGSPAGSPTSTEEG<br>TSTEPSEGSAPGTSTEPSEGSAPGGSAP | 292 |
| 8897 Ref-C | C-terminal XTEN | PGSPAGSPTSTEEGTSESATPESGPGTSTEPSEGSAPGSPAGSPTSTEEGTST<br>EPSEGSAPGTSTEPSEGSAPGTSESATPESGPGSEPATSGSETPGSEPATSGS<br>ETPGSPAGSPTSTEEGTSESATPESGPGTSTEPSEGSAPGTSTEPSEGSAPGS<br>PAGSPTSTEEGTSTEPSEGSAPGTSTEPSEGSAPGTSESATPESGPGTSTEPS<br>EGSAPGTSESATPESGPGSEPATSGSETPGTSTEPSEGSAPGTSTEPSEGSA<br>PGTSESATPESGPGTSESATPESGPGSPAGSPTSTEEGTSESATPESGPGSEP<br>ATSGSETPGTSESATPESGPGTSTEPSEGSAPGTSTEPSEGSAPGTSTEPSEG<br>SAPGTSTEPSEGSAPGTSTEPSEGSAPGTSTEPSEGSAPGSPAGSPTSTEEG<br>TSTEPSEGSAPGTSESATPESGPGSEPATSGSETPGTSESATPESGPGSEPAT<br>SGSETPGTSESATPESGPGTSTEPSEGSAPGTSESATPESGPGSPAGSPTSTE<br>EGSPAGSPTSTEEGSPAGSPTSTEEGTSESATPESGPGTSTEPSEGSAPGAA<br>EPEA | 584 |

Example 4: Recombinant Construction and Production of Barcoded XTENylated Fusion Polypeptides Examples 4a-4b illustrate the recombinant construction, production, and purification of full-length polypeptides containing barcoded XTEN polypeptide(s) using the methods disclosed herein.

Example 4a. An XTENylated Fusion Polypeptide Containing a Barcoded XTEN at the C-Terminus EXPRESSION: Constructs encoding an XTENylated fusion polypeptide containing an anti-EpCAM single-chain variable fragment (scFv) and a 864 amino acid-long, barcoded XTEN sequence (SEQ ID NO: 8008) at the C-terminus are expressed in a proprietary *E. coli* AmE098 strain and partitioned into the periplasm via an N-terminal secretory leader sequence (MKKNIAFLLASMFVFSIATNAYA-) (SEQ ID NO: 8898), which is cleaved during translocation. Fermentation cultures are grown with animal-free complex medium at 37° C.; and the temperature is shifted to 26° C. prior to phosphate depletion. During harvest, fermentation whole broth is centrifuged to pellet the cells. At harvest, the total volume and the wet cell weight (WCW; ratio of pellet to supernatant) is recorded, and the pelleted cells are collected and frozen at −80° C.

RECOVERY: The frozen cell pellet is resuspended in Lysis Buffer (17.7 mM citric acid, 22.3 mM $Na_2HPO_4$, 75 mM NaCl, 2 mM EDTA, pH 4.0) targeting 30% wet cell weight. The resuspension is allowed to equilibrate at pH 4 then homogenized via two passes at 800±50 bar while output temperature is monitored and maintained at 15±5° C. The pH of the homogenate is confirmed to be within the specified range (pH 4.0±0.2).

CLARIFICATION: To reduce endotoxin and host cell impurities, the homogenate is allowed to undergo low-temperature (10±5° C.), acidic (pH 4.0±0.2) flocculation overnight (15-20 hours). To remove the insoluble fraction, the flocculated homogenate is centrifuged for 40 minutes at 16,900 RCF at 2-8° C., and the supernatant is retained. The supernatant is diluted approximately 3-fold with Milli-Q water (MQ), then adjusted to 7±1 mS/cm with 5 M NaCl. To remove nucleic acid, lipids, and endotoxin and to act as a filter aid, the supernatant is adjusted to 0.1% (m/m) diatomaceous earth. To keep the filter aid suspended, the supernatant is mixed via impeller and allowed to equilibrate for 30 minutes. A filter train, consisting of a depth filter followed by a 0.22 μm filter, is assembled then flushed with MQ. The supernatant is pumped through the filter train while modulating flow to maintain a pressure drop of 25±5 psig. To adjust the composite buffer system (based on the ratio of citric acid and $Na_2HPO_4$) to the desired range for capture chromatography, the filtrate is adjusted with 500 mM $Na_2HPO_4$ wherein the final ratio of $Na_2HPO_4$ to citric acid is 9.33:1, and the pH of the buffered filtrate is confirmed to be within the specified range (pH 7.0±0.2).

Purification

AEX Capture: To separate dimer, aggregate, and large truncates from monomeric product, and to remove endotoxin and nucleic acids, anion exchange (AEX) chromatography is utilized to capture the electronegative C-terminal XTEN domain. The AEX1 stationary phase (GE Q Sepharose FF), AEX1 mobile phase A (12.2 mM $Na_2HPO_4$, 7.8 mM $NaH_2PO_4$, 40 mM NaCl), and AEX1 mobile phase B (12.2 mM $Na_2HPO_4$, 7.8 mM $NaH_2PO_4$, 500 mM NaCl) are used herein. The column is equilibrated with AEX1 mobile phase A. Based on the total protein concentration measured by bicinchoninic acid (BCA) assay, the filtrate is loaded onto the column targeting 28±4 g/L-resin, chased with AEX1 mobile phase A, then washed with a step to 30% B. Bound material is eluted with a gradient from 30% B to 60% B over 20 CV. Fractions are collected in 1 CV aliquots while A220≥100 mAU above (local) baseline. Elution fractions are analyzed and pooled on the basis of SDS-PAGE and SE-HPLC.

IMAC Intermediate Purification: To ensure C-terminal integrity, immobilized metal affinity chromatography (IMAC) is used to capture the C-terminal polyhistidine tag (His(6) (SEQ ID NO: 8031)). The IMAC stationary phase (GE IMAC Sepharose FF), IMAC mobile phase A (18.3 mM $Na_2HPO_4$, 1.7 mM $NaH_2PO_4$, 500 mM NaCl, 1 mM imidazole), and IMAC mobile phase B (18.3 mM $Na_2HPO_4$, 1.7 mM $NaH_2PO_4$, 500 mM NaCl, 500 mM imidazole) are used herein. The column is charged with zinc solution and equilibrated with IMAC mobile phase A. The AEX1 Pool is adjusted to pH 7.8±0.1, 50±5 mS/cm (with 5 M NaCl), and 1 mM imidazole, loaded onto the IMAC column targeting 2 g/L-resin, and chased with IMAC mobile phase A until absorbance at 280 nm (A280) returned to (local) baseline. Bound material is eluted with a step to 25% IMAC mobile phase B. The IMAC Elution collection is initiated when A280≥10 mAU above (local) baseline, directed into a container pre-spiked with EDTA sufficient to bring 2 CV to 2 mM EDTA, and terminated once 2 CV were collected. The elution is analyzed by SDS-PAGE.

Protein-L Intermediate Purification: To ensure N-terminal integrity, Protein-L is used to capture kappa domains present close to the N-terminus of the BPXTEN molecule (specifically the aEpCAM scFv). Protein-L stationary phase (GE Capto L), Protein-L mobile phase A (16.0 mM citric acid, 20.0 mM $Na_2HPO_4$, pH 4.0±0.1), Protein-L mobile phase B (29.0 mM citric acid, 7.0 mM $Na_2HPO_4$, pH 2.60±0.02), and Protein-L mobile phase C (3.5 mM citric acid, 32.5 mM $Na_2HPO_4$, 250 mM NaCl, pH 7.0±0.1) are used herein. The column is equilibrated with Protein-L mobile phase C. The IMAC Elution is adjusted to pH 7.0±0.1 and 30±3 mS/cm (with 5 M NaCl and MQ) and loaded onto the Protein-L column targeting 2 g/L-resin then chased with Protein-L mobile phase C until absorbance at 280 nm (A280) returns to (local) baseline. The column is washed with Protein-L mobile phase A, and Protein-L mobile phases A and B are used to effect low-pH elution. Bound material is eluted at approximately pH 3.0 and collected into a container pre-spiked with one part 0.5 M $Na_2HPO_4$ for every 10 parts collected volume. Fractions are analyzed by SDS-PAGE.

HIC Polishing: To separate N-terminal variants (4 residues at the absolute N-terminus are not essential for Protein-L binding) and overall conformation variants, hydrophobic interaction chromatography (HIC) is used. HIC stationary phase (GE Capto Phenyl ImpRes), HIC mobile phase A (20 mM histidine, 0.02% (w/v) polysorbate 80, pH 6.5±0.1) and HIC mobile phase B (1 M ammonium sulfate, 20 mM histidine, 0.02% (w/v) polysorbate 80, pH 6.5±0.1) are used herein. The column is equilibrated with HIC mobile phase B. The adjusted Protein-L Elution is loaded onto the HIC column targeting 2 g/L-resin and chased with HIC mobile phase B until absorbance at 280 nm (A280) returned to (local) baseline. The column is washed with 50% B. Bound material is eluted with a gradient from 50% B to 0% B over 75 CV. Fractions are collected in 1 CV aliquots while A280≥3 mAU above (local) baseline. Elution fractions are analyzed and pooled on the basis of SE-HPLC and HI-HPLC.

FORMULATION: To exchange the product into formulation buffer and to bring the product to the target concentration (0.5 g/L), anion exchange is again used to capture the C-terminal XTEN. AEX2 stationary phase (GE Q Sepharose FF), AEX2 mobile phase A (20 mM histidine, 40 mM NaCl, 0.02% (w/v) polysorbate 80, pH 6.5±0.2), AEX2 mobile phase B (20 mM histidine, 1 M NaCl, 0.02% (w/v) polysorbate 80, pH 6.5±0.2), and AEX2 mobile phase C (12.2 mM $Na_2HPO_4$, 7.8 mM $NaH_2PO_4$, 40 mM NaCl, 0.02% (w/v) polysorbate 80, pH 7.0±0.2) are used herein. The column is equilibrated with AEX2 mobile phase C. The HIC Pool is adjusted to pH 7.0±0.1 and 7±1 mS/cm (with MQ) and loaded onto the AEX2 column targeting 2 g/L-resin then chased with AEX2 mobile phase C until A280 returned to (local) baseline. The column is washed with AEX2 mobile phase A (20 mM histidine, 40 mM NaCl, 0.02% (w/v) polysorbate 80, pH 6.5±0.2). AEX2 mobile phases A and B are used to generate an {NaCl} step and effect elution. Bound material is eluted with a step to 38% AEX2 mobile phase B. The AEX2 Elution collection is initiated when A280≥5 mAU above (local) baseline and terminated once 2 column volumes were collected. The AEX2 Elution is 0.22 μm filtered within a BSC, aliquoted, labeled, and stored at −80° C. as Bulk Drug Substance (BDS). The bulk drug substance (BDS) is confirmed by various analytical methods to meet all lot release criteria. Overall quality is analyzed by SDS-PAGE, the ratio of monomer to dimer and aggregate is analyzed by SE-HPLC, and N-terminal quality and product homogeneity are analyzed by HI-HPLC.

Example 4b. An XTENylated Fusion Polypeptide Containing a Barcoded XTEN at the C-Terminus and Another Barcoded XTEN at the N-Terminus EXPRESSION: A construct encoding an XTENylated fusion polypeptide containing anti-EGFR single-chain variable fragment (scFv), a 864 amino acid-long barcoded XTEN (SEQ ID NO: 8008) at the C-terminus, and a 288 amino acid-long barcoded XTEN (SEQ ID NO: 8007) at the N-terminus is expressed in a proprietary *E. coli* AmE098 strain and partitioned into the periplasm via an N-terminal secretory leader sequence (MKKNIAFLLASMFVFSIATNAYA-)(SEQ ID NO: 8898), which is cleaved during translocation. Fermentation cultures are grown with animal-free complex medium at 37° C. and temperature shifted to 26° C. prior to phosphate depletion. During harvest, fermentation whole broth is centrifuged to pellet the cells. At harvest, the total volume and the wet cell weight (WCW; ratio of pellet to supernatant) are recorded, and the pelleted cells are collected and frozen at −80° C.

RECOVERY: The frozen cell pellet is resuspended in Lysis Buffer (100 mM citric acid) targeting 30% wet cell weight. The resuspension is allowed to equilibrate at pH 4.4 then homogenized at 17,000±200 bar while output temperature is monitored and maintained at 15±5° C. The pH of the homogenate is confirmed to be within the specified range (pH 4.4±0.1).

CLARIFICATION: To reduce endotoxin and host cell impurities, the homogenate is allowed to undergo low-temperature (10±5° C.), acidic (pH 4.4±0.1) flocculation overnight (15-20 hours). To remove the insoluble fraction, the flocculated homogenate is centrifuged for 40 minutes at 8,000 RCF and 2-8° C., and the supernatant is retained. To remove nucleic acid, lipids, and endotoxin and to act as a filter aid, the supernatant is adjusted to 0.1% (m/m) diatomaceous earth. To keep the filter aid suspended, the supernatant is mixed via impeller and allowed to equilibrate for 30 minutes. A filter train, consisting of a depth filter followed by a 0.22 μm filter, is assembled then flushed with MQ. The supernatant is pumped through the filter train while modulating flow to maintain a pressure drop of 25±5 psig.

Purification

Protein-L Capture: To remove host cell proteins, endotoxin, and nucleic acid, Protein-L is used to capture the kappa domain present within the aEGFR scFv of the BPX-TEN molecule. The Protein-L stationary phase (Tosoh TP AF-rProtein L-650F), Protein-L mobile phase A (11.5 mM citric acid, 24.5 mM $Na_2HPO_4$, 125 mM NaCl, 0.005% polysorbate 80, pH 5.0), and Protein-L mobile phase B (11 mM phosphoric acid, 0.005% polysorbate 80, pH 2.0) are used herein. The column is equilibrated with Protein-L mobile phase A. The filtrate is adjusted to pH 5.5±0.2 and loaded onto the Protein-L column targeting 2-4 g/L-resin then chased with Protein-L mobile phase A until absorbance at 280 nm (A280) returns to (local) baseline. Bound material is eluted with mobile phase B and collected as a 2 CV fraction pre-spiked with 0.4 CV of 0.5 M $Na_2HPO_4$ and is analyzed by SDS-PAGE.

IMAC Intermediate Purification: To ensure N-terminal integrity, Immobilized Metal Affinity Chromatography (IMAC) is used to capture the N-terminal polyhistidine tag (His(6); (SEQ ID NO: 8031)) of the fusion polypeptide molecule. The IMAC stationary phase (GE IMAC Sepharose FF), IMAC mobile phase A (12.2 mM $Na_2HPO_4$, 7.8 mM $NaH_2PO_4$, 500 mM NaCl, 0.005% polysorbate 80, pH 7.0), and IMAC mobile phase B (50 mM histidine, 200 mM NaCl, 0.005% polysorbate 80, pH 6.5) are used herein. The column is equilibrated with IMAC mobile phase A. The Protein-L Elution is adjusted to pH 7.8±0.1 and 50±5 mS/cm (with 5 M NaCl). The adjusted Protein-L Pool is loaded onto the IMAC column targeting 2 g/L-resin and chased with IMAC mobile phase A until absorbance at 280 nm (A280) returned to (local) baseline. Bound material is eluted with IMAC mobile phase B. The IMAC Elution is collected as a 2 CV fraction pre-spiked with 0.02 CV 200 mM EDTA and is analyzed by SDS-PAGE.

C-tag Intermediate Purification: To ensure C-terminal integrity, C-tag Affinity Chromatography is used to capture the C-terminal-EPEA tag (SEQ ID NO: 8033). The C-tag stationary phase (Thermo C-tagXL), C-tag mobile phase A (50 mM histidine, 200 mM NaCl, 0.005% polysorbate 80, pH 6.5), and C-tag mobile phase B (20 mM Tris, 0.6 M $MgCl_2$, 0.005% polysorbate 80, pH 7.0) are used herein. The column is equilibrated with C-tag mobile phase A. The IMAC Elution is loaded onto the C-tag column targeting 2 g/L-resin and chased with C-tag mobile phase A until absorbance at 280 nm (A280) returned to (local) baseline. Bound material is eluted with a C-tag mobile phase B. The C-tag Elution is collected as a 2 CV fraction and is analyzed by SDS-PAGE.

AEX Polishing: To separate dimer and aggregate from monomeric product Anion Exchange (AEX) chromatography is utilized to capture the electronegative N- and C-terminal XTEN domains. The AEX1 stationary phase (BIA QA-80), AEX1 mobile phase A (50 mM histidine, 200 mM NaCl, 0.005% polysorbate 80, pH 6.5), and AEX1 mobile phase B (50 mM histidine, 500 mM NaCl, 0.005% polysorbate 80, pH 6.5) are used herein. The column is equilibrated with AEX mobile phase A. The C-tag elution is diluted to 10 mS/cm with MQ, loaded targeting 2 g/L-resin, and then chased with AEX mobile phase A until absorbance at 280 nm returned to (local) baseline. Bound material is eluted with a gradient from 0% B to 100% B over 60 CV. Fractions are collected in 1 CV aliquots while A280≥2 mAU above (local) baseline. Elution fractions are analyzed by SDS-PAGE and SE-HPLC, and fractions found to be ≥98% monomer are pooled (AEX Pool) for further processing.

FORMULATION: To exchange the product into formulation buffer and to bring the product to the target concentration (0.5 g/L), Ultrafiltration/Diafiltration (UF/DF) is used. Using a 10 kDa membrane with an area of 0.1 $m^2$ and a TMP target of 15 psi, the AEX pool is concentrated to 0.5 g/L, then diluted 10-fold with Formulation Buffer (50 mM histidine, 200 mM NaCl, 0.005% polysorbate 80, pH 6.5). The AEX pool is concentrated 10-fold and diluted 10-fold two more times. The recovered Formulated product is 0.22 μm filtered within a BSC, aliquoted, labeled, and stored at −80° C. as Bulk Drug Substance (BDS). The BDS is confirmed by various analytical methods to meet all Lot Release criteria. Overall quality is analyzed by SDS-PAGE, the ratio of monomer to dimer and aggregate is analyzed by SE-HPLC, and N-terminal quality and product homogeneity is analyzed by HI-HPLC. Identity is confirmed by ESI-MS.

Example 5. Release of Barcode Peptides by Protease Digest

This example illustrates the release of barcode fragment (s) and reference fragment(s) from a polypeptide mixture that contain varying lengths or truncated forms of the XTEN-containing construct using the methods disclosed herein.

A sample of XTEN-containing construct is reduced and alkylated via incubation in DTT and then iodoacetamide, sequentially. The samples are then buffer exchanged and desalted using a size-exclusion spin cartridge. Glu-C protease is added to the samples at an enzyme to substrate ratio of 1:5 and the samples are incubated at 37° C. for digestion. Samples are then moved to 4° C. to halt the proteolytic reaction and placed in autosampler vials for analysis.

Example 6. Detection and Quantification of Barcode Peptide(s) and Reference Peptide(s)

This example illustrates mass spectrometry methods used to generate quantitative measurements of individual barcode peptides. An LC-Parallel Reaction Monitoring (PRM) method is programmed into a high-resolution accurate mass (HRAM) mass spectrometer. Unlike traditional Data-Dependent Acquisition (DDA) mass spectrometry methods, PRM methods focus on a specific set of 15-30 peptides in one run, sequencing each by MS-MS once per duty cycle. As such, this method generates eXtracted Ion Chromatograms (XICs) for the unfragmented precursor ions of the intact peptide, as well as for each fragment ion of the peptide to confirm its sequence. Fragment ion XICs are often more sensitive and selectively quantitative than the precursor ion fragments. The LC-PRM method used includes the light and heavy versions of seven barcode peptides. Chromatographic peak areas of all fragment ions of these 14 peptides are measured post-acquisition and the strongest fragment ion is used for quantitative measurement. Peak area ratios of the XTEN barcode peptides to the PAT barcode peptides are then calculated for relative XTEN:PAT abundance at various points across the XTEN molecules.

Example 7. Stable Isotope Labeling to Quantify the Peptides by Mass Spectrometry (MS)

This example illustrates the stable-isotope labeling schema to enable absolute (rather than relative) quantitation of barcode peptides from XTEN-containing polypeptides. A standard Heavy labeled Amino acid quantitative schema is employed wherein synthetic analogues of barcode peptides in which the C-terminal Glutamic Acid is replaced with the $(^{13}C)_5H_7(^{15}N)O_3$ heavy labeled analogue are procured from a specialized vendor. A calibration curve is prepared where a known amount of XTEN barcode containing polypeptide is serially diluted into a matrix where the heavy-labeled synthetic peptide is held at a constant concentration. Accurate quantitation can be performed by calibrating chromatographic peak area heavy:light ratios from the curve against research samples containing the same spike-level of heavy labeled peptide.

Example 8. Quantification of Truncation of XTEN-Containing Polypeptide

This example illustrates the quantification of length variants or truncation variants in a mixture of XTEN-containing polypeptides.

For example, a barcode peptide "SGPGSTPAESGSE" (SEQ ID NO: 8899) is located 76 amino acids into the representative barcoded BPXTEN sequence described in and obtained from Example 3 to indicate a severe truncation of the XTEN at the N-terminal end of the BPXTEN. Also consider a potential barcode fragment "SPAGSPTSTESGTSE" (SEQ ID NO: 8260) is located at the N-terminus. The abundance measurement ratio of each barcode peptide relative to a unique reference peptide sequence from the biologically active protein (e.g., an scFv fragment) sequence following the procedure of Example 6 indicates the total amount of the full-length polypeptides and the variants having truncations that could affect pharmacological efficacy in the sample mixture. The abundance measurement of at least one reference fragment is used to indicate the total amount of all variants of the polypeptide in the sample mixture. Accordingly, differential abundance between the reference fragment and the barcode fragments informs the amount of truncated polypeptide variants. The LC-MS data are analyzed to determine the ratio of the amount of the barcode fragment to the reference fragment, indicating the relative amount of pharmacologically-efficacious variants in the polypeptide mixture.

A set of two (or three) barcodes are used to indicate different levels of truncation of the polypeptide. The LC-MS data are used to determine the ratio of the amount of each barcode fragment to the amount of the reference fragment, thereby quantifying the distribution of truncation variants in the polypeptide mixture.

Example 9. Quantification of Truncation of XTEN-Containing Polypeptide

A step in the purification of AC2329 is QIR Anion Exchange Chromatography. The second half of the main elution peak from this column contains the full-length protein, while the first half of the peak contains a mixture of full-length protein as well as many truncated forms. For the purposes of barcode peptide evaluation, two fractions were taken. One fraction included only the second half of the peak, heretofore referred to as the "full-length" fraction. The second fraction included the first half of the peak, heretofore referred to as the Synthetic Protein and Truncates" fraction, set forth herein:

Analytical size exclusion chromatography (SEC) overlaying the full-length (blue) fraction and the full-length+truncates fraction (Black). It is apparent that the Synthetic protein+truncates fraction includes fragments as large as intact synthetic protein, but many smaller components as well as indicated by the large sloping shoulder on the right side of the peak.

Full-length synthetic protein and full-length synthetic protein and truncates were mixed in ratios described in Dilution matrix.

Dilution matrix

| Dilution | 1 | 2 | 3 | 4 | 5 | 6 | 7 | 8 | 9 |
|---|---|---|---|---|---|---|---|---|---|
| Compound 1 (nM) | 400 | 350 | 300 | 250 | 200 | 150 | 100 | 50 | 0 |
| Compound 1 trunc (nM) | 0 | 50 | 100 | 150 | 200 | 250 | 300 | 350 | 400 |
| Total nM | 400 | 400 | 400 | 400 | 400 | 400 | 400 | 400 | 400 |
| Total vol | 60 | 60 | 60 | 60 | 60 | 60 | 60 | 60 | 60 |

Each of the 400 nM samples were then digested with 1 mg/mL GluC (Roche 10791156001) in reaction buffer containing 50 mM Tris-HCl pH 7.5+0.1% Rapigest (Waters 186001861). GluC digest was performed overnight at 37° C. in a shaking incubator. Following digestion, formic acid was added to a final concentration of 10% and incubated at 37° C. for 45 min. Rapigest precipitates were removed by centrifugation at 16,000×g for 10 min, and a heavy peptide standard mix was added to a final concentration of 400 nM. LC-MS analysis of each digest was performed as described. Each sample was measured in duplicate.

Analysis by LC-MS

Digests were analyzed using a 30-minute gradient method on a Waters HSS-T3 column (176003994) using a Vanquish (Thermo) UHPLC system connected to a Q-Exactive Plus mass Spectrometer (Thermo). The MS method consisted of a top-ten DDA method in which the top ten peptides were sequenced by MSMS analysis after each MS scan. Resultant data files were processed using Skyline Software (MacCoss Lab, UW) software in which the heavy-peptide normalized concentrations of each barcode peptide could be calculated and measured.

Figure 5A:
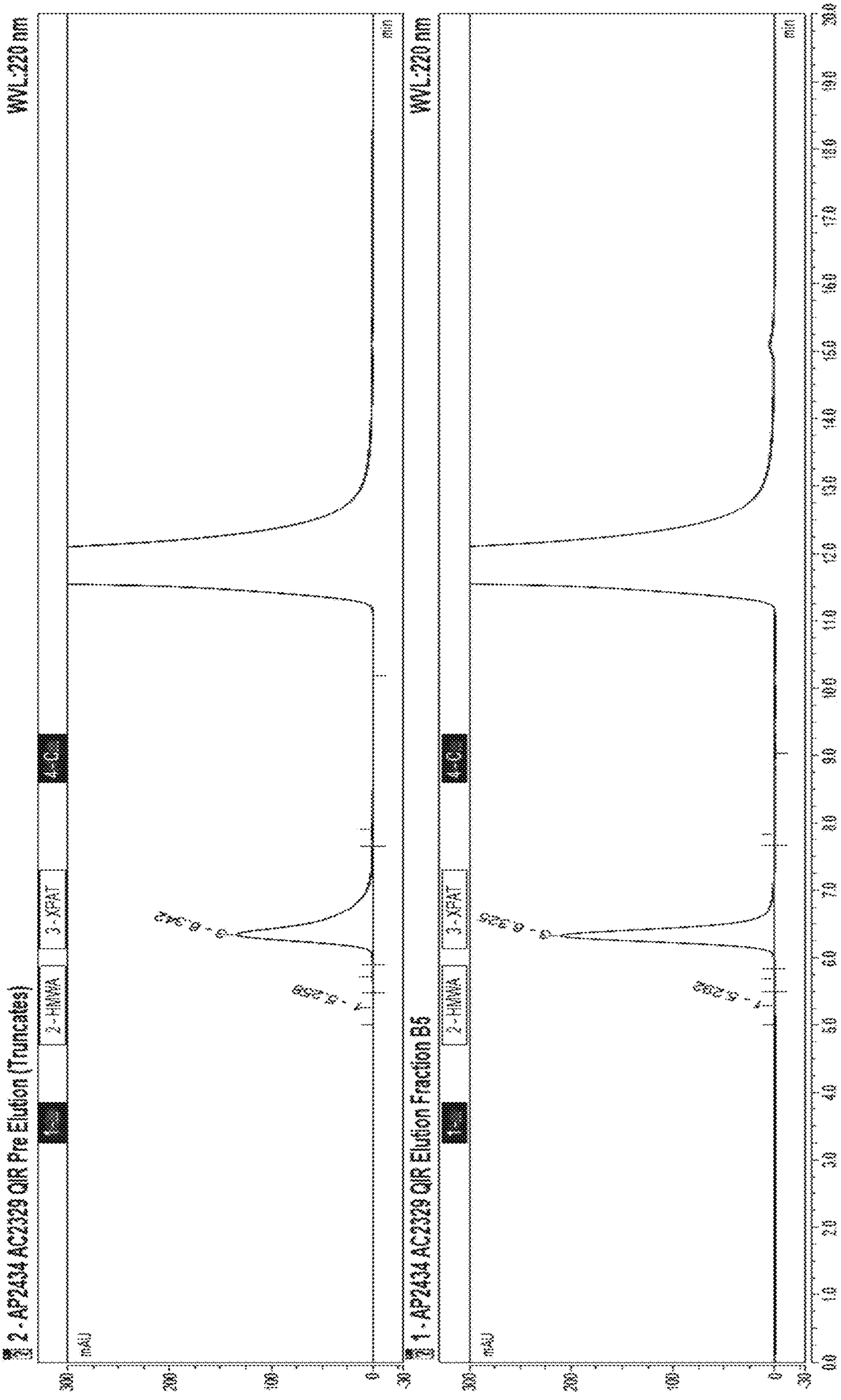
FIG. 5A illustrates analytical size exclusion chromatography (SEC) of XPAT protein and detection of full-length protein and truncated derivatives thereof. The Synthetic protein+truncates fraction includes fragments as large as intact synthetic protein.
Figure 5B:
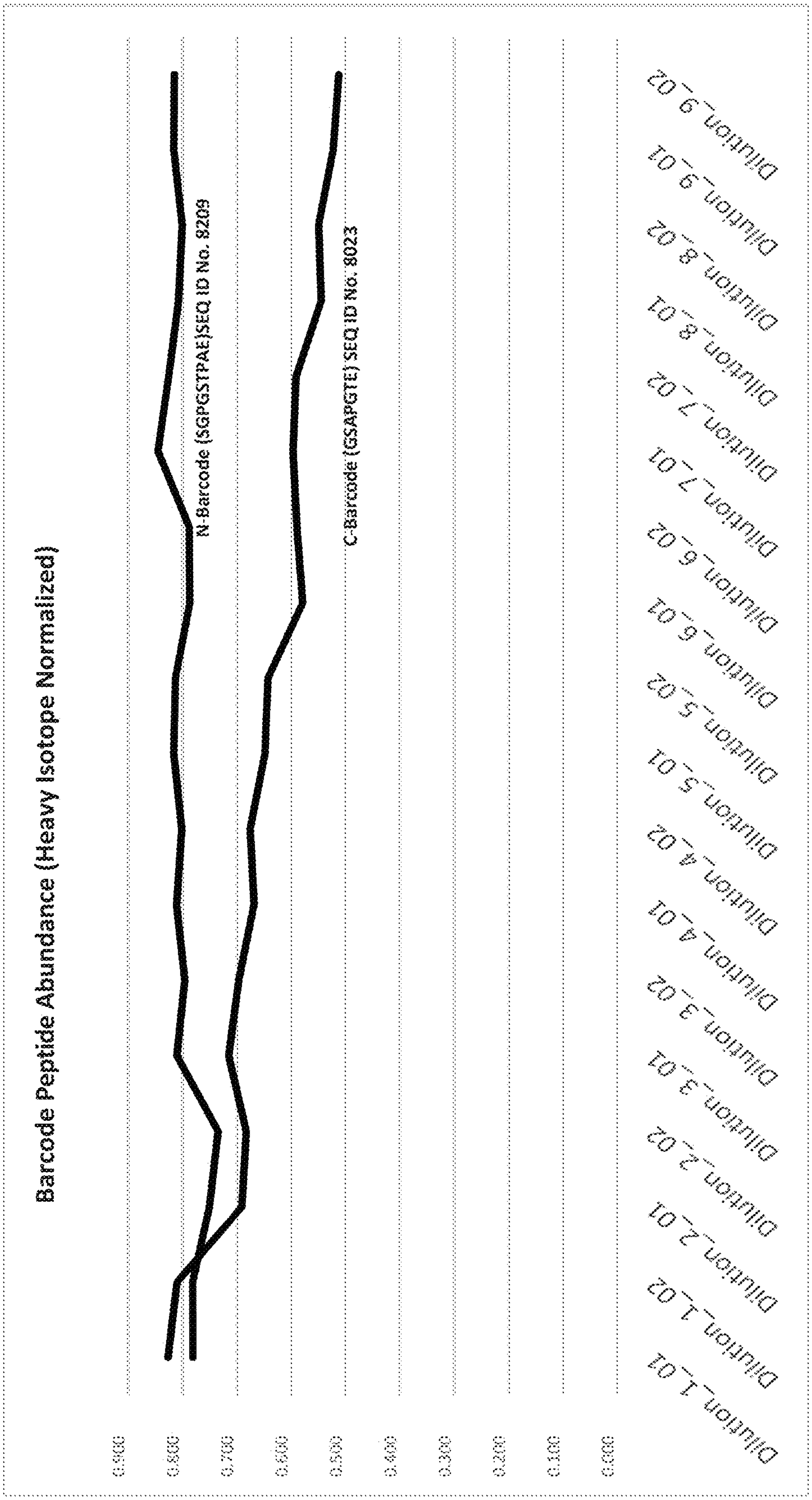
FIG. 5B illustrates the abundance of Barcode peptides in XPAT preparations as detected by mass spectrometry. Each measurement is the XIC area of N-Barcode SGPGSTPAE (SEQ ID No. 8029) and, C-Barcode GSAPGTE (SEQ ID No. 8023) normalized to a 400 nM Spike of its corresponding heavy isotope labeled Synthetic peptide.

Each measurement, as shown in FIG. 5B, is the XIC area of N-Barcode SGPGSTPAE (SEQ ID No. 8029) and, C-Barcode GSAPGTE (SEQ ID No. 8023) normalized to a 400 nM Spike of its corresponding heavy isotope labeled Synthetic peptide. Dilution 1 has the lowest amount of truncates and dilution 9 has the highest amount. These data indicate that the N-Barcode peptide is measured at a relatively similar abundance across truncate and non-truncate containing samples. However, a decreasing abundance of the C-Barcode peptide is seen in the truncate-containing fraction. This suggests that translation termination is the strongest contributing factor to the truncated species, as translation in prokaryotes is initiated at the N-terminus.

Having described the invention in detail and by reference to specific aspects and/or embodiments thereof, it will be apparent that modifications and variations are possible without departing from the scope of the invention defined in the appended claims. More specifically, although some aspects of the present invention can be identified herein as particularly advantageous, it is contemplated that the present invention is not limited to these particular aspects of the invention.

SEQUENCE LISTING (9399 sequences)

SEQ ID NO: 1 - protein, 52 aa, Unknown
  Description of Unknown: Adrenomedullin sequence
YRQSMNNFQGLRSFGCRFGTCTVQKLAHQIYQFTDKDKDNVAPRSKISPQGY

SEQ ID NO: 2 - protein, 37 aa, Rattus sp.
KCNTATCATQRLANFLVRSSNNLGPVLPPTNVGSNTY

SEQ ID NO: 3 - protein, 37 aa, Homo sapiens [sequence omitted]

SEQ ID NO: 4 - protein, 32 aa, Homo sapiens
CGNLSTCMLGTYTQDFNKFHTFPQTAIGVGAP

SEQ ID NO: 5 - protein, 32 aa, Salmo salar
CSNLSTCVLGKLSQELHKLQTYPRTNTGSGTP

SEQ ID NO: 6 - protein, 36 aa, Homo sapiens
ACDTATCVTHRLAGLLSRSGGVVKNMVPTNVGSKAF

SEQ ID NO: 7 - protein, 37 aa, Homo sapiens
ACNTATCVTHRLAGLLSRSGGMVKSNFVPTNVGSKAF

SEQ ID NO: 8 - protein, 115 aa, Unknown
  Description of Unknown: cholecystokinin sequence
MNSGVCLCVLMAVLAAGALTQPVPPADPAGSGLQRAEEAPRRQLRVSQRTDGESRAHLGALLARYIQQARKAPSGRMSIVKNLQNLDPSHRISDRDYMGWMDFGRRSAEEYEYPS

SEQ ID NO: 9 - protein, 33 aa, Unknown
  Description of Unknown: CCK-33 sequence
KAPSGRMSIVKNLQNLDPSHRISDRDYMGWMDF

SEQ ID NO: 10 - protein, 8 aa, Unknown [sequence omitted]

SEQ ID NO: 11 - protein, 39 aa, Unknown
  Description of Unknown: Exendin-3 sequence
HSDGTFTSDLSKQMEEEAVRLFIEWLKNGGPSSGAPPPS

SEQ ID NO: 12 - protein, 39 aa, Unknown
  Description of Unknown: Exendin-4 sequence
HGEGTFTSDLSKQMEEEAVRLFIEWLKNGGPSSGAPPPS

SEQ ID NO: 13 - protein, 216 aa, Unknown
  Description of Unknown: FGF-19 sequence
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 14 - protein, 209 aa, Unknown
  Description of Unknown: FGF-21 sequence
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 15 - protein, 34 aa, Unknown
  Description of Unknown: Gastrin sequence
QLGPQGPPHLVADPSKKQGPWLEEEEEAYGWMDF

SEQ ID NO: 16 - protein, 22 aa, Unknown
  Description of Unknown: Gastrin-17 sequence
DPSKKQGPWLEEEEEAYGWMDF

SEQ ID NO: 17 - protein, 42 aa, Unknown
  Description of Unknown: Gastric inhibitory polypeptide (GIP) sequence
YAEGTFISDYSIAMDKIHQQDFVNWLLAQKGKKNDWKHNITQ

SEQ ID NO: 18 - protein, 28 aa, Unknown
  Description of Unknown: Ghrelin sequence
GSSFLSPEHQRVQQRKESKKPPAKLQPR

SEQ ID NO: 19 - protein, 29 aa, Unknown
  Description of Unknown: Glucagon sequence
HSQGTFTSDYSKYLDSRRAQDFVQWLMNT

SEQ ID NO: 20 - protein, 37 aa, Homo sapiens
HDEFERHAEGTFTSDVSSTLEGQAALEFIAWLVKGRG

SEQ ID NO: 21 - protein, 30 aa, Homo sapiens
HAEGTFTSDVSSYLEGQAALEFIAWLVKGR

SEQ ID NO: 22 - protein, 31 aa, Homo sapiens
HAEGTFTSDVSSTLEGQAALEFIAWLVKGRG

SEQ ID NO: 23 - protein, 37 aa, Xenopus sp.
HAEGTYTNDVTEYLEEKAAKEFIEWLIKGKPKKIRYS

SEQ ID NO: 24 - protein, 33 aa, Homo sapiens
HADGSFSDEMNTILDNLAARDFINWLIETKITD

SEQ ID NO: 25 - protein, 31 aa, Xenopus sp.
HAEGTFTNDMTNYLEEKAAKEFVGWLIKGRP

SEQ ID NO: 26 - protein, 70 aa, Unknown
  Description of Unknown: IGF-1 sequence
GPETLCGAELVDALQFVCGDRGFYFNKPTGYGSSSRRAPQTGIVDECCFRSCDLRRLEMYCAPLKPAKSA

SEQ ID NO: 27 - protein, 67 aa, Unknown
  Description of Unknown: IGF-2 sequence
AYRPSETLCGGELVDTLQFVCGDRGFYFSRPASRVSRRSRGIVEECCFRSCDLALLETYCATPAKSE

SEQ ID NO: 28 - protein, 149 aa, Unknown
  Description of Unknown: islet neogenesis-associated protein
EESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 29 - protein, 47 aa, Unknown
  Description of Unknown: Intermedin (AFP-6) sequence
TQAQLLRVGCVLGTCQVQNLSHRLWQLMGPAGRQDSAPVDPSSPHSY

SEQ ID NO: 30 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 31 - protein, 8 aa, Sus scrofa
YFLFRPRN

SEQ ID NO: 32 - protein, 9 aa, Unknown
  Description of Unknown: Neuromedin (U-9) sequence
GYFLFRPRN

SEQ ID NO: 33 - protein, 25 aa, Homo sapiens
FRVDEEFQSPFASQSRGYFLFRPRN

SEQ ID NO: 34 - protein, 25 aa, Sus scrofa
FKVDEEFQGPIVSQNRRYFLFRPRN

SEQ ID NO: 35 - protein, 33 aa, Homo sapiens
ILQRGSGTAAVDFTKKDHTATWGRPFFLFRPRN

SEQ ID NO: 36 - protein, 23 aa, Rattus sp.
YKVNEYQGPVAPSGGFFLFRPRN

SEQ ID NO: 37 - protein, 37 aa, Unknown
  Description of Unknown: oxyntomodulin (OXM) sequence
HSQGTFTSDYSKYLDSRRAQDFVQWLMNTKRNRNNIA

SEQ ID NO: 38 - protein, 36 aa, Unknown
  Description of Unknown: Peptide YY (PYY) sequence
YPIKPEAPGEDASPEELNRYYASLRHYLNLVTRQRY

SEQ ID NO: 39 - protein, 37 aa, Unknown
  Description of Unknown: Pramlintide sequence
KCNTATCATNRLANFLVHSSNNFGPILPPTNVGSNTY

SEQ ID NO: 40 - protein, 40 aa, Unknown
  Description of Unknown: Urocortin (Ucn-1) sequence
DNPSLSIDLTFHLLRTLLELARTQSQRERAEQNRIIFDSV

SEQ ID NO: 41 - protein, 41 aa, Unknown
  Description of Unknown: Urocortin (Ucn-2) sequence
IVLSLDVPIGLLQILLEQARARAAREQATTNARILARVGHC

SEQ ID NO: 42 - protein, 38 aa, Unknown
  Description of Unknown: Urocortin (Ucn-3) sequence
FTLSLDVPTNIMNLLFNIAKAKNLRAQAAANAHLMAQI

SEQ ID NO: 43 - protein, 37 aa, Artificial Sequence; identical to SEQ ID NO: 39
  Description of Artificial Sequence: Synthetic polypeptide

SEQ ID NO: 44 - protein, 37 aa, Artificial Sequence
  Description of Artificial Sequence: Synthetic polypeptide
  MOD_RES (10)..(10): Asn or Gln
  MOD_RES (25)..(25): Ser, Pro, or Gly
  MOD_RES (28)..(29): Ser, Pro, or Gly
KCNTATCATXRLANFLVHSSNNFGXILXXTNVGSNTY

SEQ ID NO: 45 - protein, 37 aa, Artificial Sequence
  Description of Artificial Sequence: Synthetic polypeptide
KCNTATCATNRLANFLVHSSNNFGGILGGTNVGSNTY

SEQ ID NO: 46 - protein, 37 aa, Artificial Sequence; identical to SEQ ID NO: 45
  Description of Artificial Sequence: Synthetic polypeptide

SEQ ID NO: 47 - protein, 39 aa, Heloderma suspectum; identical to SEQ ID NO: 12

SEQ ID NO: 48 - protein, 37 aa, Xenopus sp.; identical to SEQ ID NO: 23

SEQ ID NO: 49 - protein, 37 aa, Xenopus laevis
HAEGTFTSDVTQQLDEKAAKEFIDWLINGGPSKEIIS

SEQ ID NO: 50 - protein, 33 aa, Xenopus laevis
HAEGTYTNDVTEYLEEKAAKEFIIEWLIKGKPK

SEQ ID NO: 51 - protein, 32 aa, Xenopus laevis
HAEGTFTNDMTNYLEEKAAKEFVGWLIKGRPK

SEQ ID NO: 52 - protein, 27 aa, Mus musculus
HAEGTFISDYSIAMDKIRQQDFVNWLL

SEQ ID NO: 53 - protein, 27 aa, Equus caballus
HAEGTFISDYSIAMDKIRQQDFVNWLL

SEQ ID NO: 54 - protein, 32 aa, Petromyzon marinus
HADGTFTNDMTSYLDAKAARDFVSWLARSDKS

SEQ ID NO: 55 - protein, 30 aa, Anguilla rostrata
HAEGTYTSDVSSYLQDQAAKEFVSWLKTGR

SEQ ID NO: 56 - protein, 30 aa, Anguilla anguilla; identical to SEQ ID NO: 55

SEQ ID NO: 57 - protein, 38 aa, Hydrolagus colliei
HADGIYTSDVASLTDYLKSKRFVESLSNYNKRQNDRRM

SEQ ID NO: 58 - protein, 31 aa, Amia calva
YADAPYISDVYSYLQDQVAKKWLKSGQDRRE

SEQ ID NO: 59 - protein, 28 aa, Ictalurus punctatus
HADGTYTSDVSSYLQEQAAKDFITWLKS

SEQ ID NO: 60 - protein, 28 aa, Anguilla sp.
HAEGTYTSDVSSYLQDQAAKEFVSWLKT

SEQ ID NO: 61 - protein, 28 aa, Bos sp.
HAEGTFTSDVSSYLEGQAAKEFIAWLVK

SEQ ID NO: 62 - protein, 28 aa, Lophius americanus
HADGTFTSDVSSYLKDQAIKDFVDRLKA

SEQ ID NO: 63 - protein, 28 aa, Hydrolagus colliei
HADGIYTSDVASLTDYLKSKRFVESLSN

SEQ ID NO: 64 - protein, 28 aa, Cavia porcellus
HSQGTFTSDYSKYLDSRRAQQFLKWLLN

SEQ ID NO: 65 - protein, 28 aa, Chinchilla sp.
HSQGTFTSDYSKHLDSRYAQEFVQWLMN

SEQ ID NO: 66 - protein, 28 aa, Lophius americanus
HSEGTFSNDYSKYLEDRKAQEFVRWLMN

SEQ ID NO: 67 - protein, 28 aa, Hydrolagus colliei
HTDGIFSSDYSKYLDNRRTKDFVQWLLS

SEQ ID NO: 68 - protein, 28 aa, Callorhinchus milii
HSEGTFSSDYSKYLDSRRAKDFVQWLMS

SEQ ID NO: 69 - protein, 28 aa, Bos taurus
YAEGTFISDYSIAMDKIRQQDFVNWLLA

SEQ ID NO: 70 - protein, 28 aa, Meleagris gallopavo
HADGIFTTVYSHLLAKLAVKRYLHSLIR

SEQ ID NO: 71 - protein, 28 aa, Gallus gallus
HIDGIFTDSYSRYRKQMAVKKYLAAVLG

SEQ ID NO: 72 - protein, 28 aa, Cavia porcellus
HSDALFTDTYTRLRKQMAMKKYLNSVLN

SEQ ID NO: 73 - protein, 28 aa, Didelphis sp.
HSDAVFTDSYTRLLKQMAMRKYLDSILN

SEQ ID NO: 74 - protein, 28 aa, Heloderma suspectum
HSDATFTAEYSKLLAKLALQKYLESILG

SEQ ID NO: 75 - protein, 28 aa, Capra hircus
YADAIFTNSYRKVLGQLSARKLLQDIMN

SEQ ID NO: 76 - protein, 28 aa, Rattus norvegicus
HADAIFTSSYRRILGQLYARKLLHEIMN

SEQ ID NO: 77 - protein, 28 aa, Mus musculus
HVDAIFTTNYRKLLSQLYARKVIQDIMN

SEQ ID NO: 78 - protein, 28 aa, Homo sapiens
VAHGILNEAYRKVLDQLSAGKHLQSLVA

SEQ ID NO: 79 - protein, 28 aa, Ovis aries
VAHGILDKAYRKVLDQLSARRYLQTLMA

SEQ ID NO: 80 - protein, 28 aa, Oncorhynchus nerka
HADGMFNKAYRKALGQLSARKYLHSLMA

SEQ ID NO: 81 - protein, 28 aa, Bos sp.
HADGSFSDEMNTVLDSLATRDFINWLLQ

SEQ ID NO: 82 - protein, 27 aa, Canis lupus familiaris
HSDGTFTSELSRLRESARLQRLLQGLV

SEQ ID NO: 83 - protein, 27 aa, Gallus gallus
HSDGLFTSEYSKMRGNAQVQKFIQNLM

SEQ ID NO: 84 - protein, 28 aa, Heloderma horridum
HSDGTFTSDLSKQMEEEAVRLFIEWLKN

SEQ ID NO: 85 - protein, 31 aa, Artificial Sequence
  Description of Artificial Sequence: Synthetic polypeptide
HAEGTFTSDVSSYLEGQAAREFIAWLVKGRG

SEQ ID NO: 86 - protein, 31 aa, Artificial Sequence
  Description of Artificial Sequence: Synthetic polypeptide
HAEGTFTSDVSSYLEGQAAKEFIAWLVRGRG

SEQ ID NO: 87 - protein, 31 aa, Artificial Sequence
  Description of Artificial Sequence: Synthetic polypeptide
HAEGTFTSDVSSYLEGQAAKEFIAWLVKGKG

SEQ ID NO: 88 - protein, 31 aa, Artificial Sequence
  Description of Artificial Sequence: Synthetic polypeptide
HAEGTFTSDVSSYLEGQAAREFIAWLVRGKG

SEQ ID NO: 89 - protein, 32 aa, Artificial Sequence
  Description of Artificial Sequence: Synthetic polypeptide
HAEGTFTSDVSSYLEGQAAREFIAWLVRGKGR

SEQ ID NO: 90 - protein, 33 aa, Artificial Sequence
  Description of Artificial Sequence: Synthetic polypeptide
HAEGTFTSDVSSYLEGQAAREFIAWLVRGRGRK

SEQ ID NO: 91 - protein, 34 aa, Artificial Sequence
  Description of Artificial Sequence: Synthetic polypeptide
HAEGTFTSDVSSYLEGQAAREFIAWLVRGRGRRK

SEQ ID NO: 92 - protein, 31 aa, Artificial Sequence
  Description of Artificial Sequence: Synthetic polypeptide
HAEGTFTSDVSSYLEGQAAREFIAWLVKGKG

SEQ ID NO: 93 - protein, 31 aa, Artificial Sequence
  Description of Artificial Sequence: Synthetic polypeptide
HAEGTFTSDVSSYLEGQAAKEFIAWLVRGKG

SEQ ID NO: 94 - protein, 33 aa, Artificial Sequence
  Description of Artificial Sequence: Synthetic polypeptide
HAEGTFTSDVSSYLEGQAAREFIAWLVKGRGRK

SEQ ID NO: 95 - protein, 34 aa, Artificial Sequence
  Description of Artificial Sequence: Synthetic polypeptide
HAEGTFTSDVSSYLEGQAAKEFIAWLVRGRGRRK

SEQ ID NO: 96 - protein, 33 aa, Artificial Sequence
  Description of Artificial Sequence: Synthetic polypeptide
HAEGTFTSDVSSYLEGQAAREFIAWLVRGKGRK

SEQ ID NO: 97 - protein, 34 aa, Artificial Sequence
  Description of Artificial Sequence: Synthetic polypeptide
HAEGTFTSDVSSYLEGQAAREFIAWLVRGKGRRK

SEQ ID NO: 98 - protein, 31 aa, Artificial Sequence
  Description of Artificial Sequence: Synthetic polypeptide
HGEGTFTSDVSSYLEGQAAREFIAWLVKGRG

SEQ ID NO: 99 - protein, 31 aa, Artificial Sequence
  Description of Artificial Sequence: Synthetic polypeptide
HGEGTFTSDVSSYLEGQAAKEFIAWLVRGRG

SEQ ID NO: 100 - protein, 31 aa, Artificial Sequence
  Description of Artificial Sequence: Synthetic polypeptide
HGEGTFTSDVSSYLEGQAAKEFIAWLVKGKG

SEQ ID NO: 101 - protein, 31 aa, Artificial Sequence
  Description of Artificial Sequence: Synthetic polypeptide
HGEGTFTSDVSSYLEGQAAREFIAWLVRGKG

SEQ ID NO: 102 - protein, 33 aa, Artificial Sequence
  Description of Artificial Sequence: Synthetic polypeptide
HGEGTFTSDVSSYLEGQAAREFIAWLVRGRGRK

SEQ ID NO: 103 - protein, 34 aa, Artificial Sequence
  Description of Artificial Sequence: Synthetic polypeptide
HGEGTFTSDVSSYLEGQAAREFIAWLVRGRGRRK

SEQ ID NO: 104 - protein, 31 aa, Artificial Sequence
  Description of Artificial Sequence: Synthetic polypeptide
HGEGTFTSDVSSYLEGQAAREFIAWLVKGKG

SEQ ID NO: 105 - protein, 31 aa, Artificial Sequence
  Description of Artificial Sequence: Synthetic polypeptide
HGEGTFTSDVSSYLEGQAAKEFIAWLVRGKG

SEQ ID NO: 106 - protein, 33 aa, Artificial Sequence
  Description of Artificial Sequence: Synthetic polypeptide
HGEGTFTSDVSSYLEGQAAREFIAWLVKGRGRK

SEQ ID NO: 107 - protein, 34 aa, Artificial Sequence
  Description of Artificial Sequence: Synthetic polypeptide
HGEGTFTSDVSSYLEGQAAKEFIAWLVRGRGRRK

SEQ ID NO: 108 - protein, 33 aa, Artificial Sequence
  Description of Artificial Sequence: Synthetic polypeptide
HGEGTFTSDVSSYLEGQAAREFIAWLVRGKGRK

SEQ ID NO: 109 - protein, 34 aa, Artificial Sequence
  Description of Artificial Sequence: Synthetic polypeptide
HGEGTFTSDVSSYLEGQAAREFIAWLVRGKGRRK

SEQ ID NO: 110 - protein, 32 aa, Artificial Sequence
  Description of Artificial Sequence: Synthetic polypeptide
HAEGTFTSDVSSYLEGQAAREFIAWLVRGRGK

SEQ ID NO: 111 - protein, 33 aa, Artificial Sequence; identical to SEQ ID NO: 90
  Description of Artificial Sequence: Synthetic polypeptide

SEQ ID NO: 112 - protein, 34 aa, Artificial Sequence; identical to SEQ ID NO: 91
  Description of Artificial Sequence: Synthetic polypeptide

SEQ ID NO: 113 - protein, 35 aa, Artificial Sequence
  Description of Artificial Sequence: Synthetic polypeptide
HAEGTFTSDVSSYLEGQAAREFIAWLVRGRGRREK

SEQ ID NO: 114 - protein, 36 aa, Artificial Sequence
  Description of Artificial Sequence: Synthetic polypeptide
HAEGTFTSDVSSYLEGQAAREFIAWLVRGRGRREFK

SEQ ID NO: 115 - protein, 37 aa, Artificial Sequence
  Description of Artificial Sequence: Synthetic polypeptide
HAEGTFTSDVSSYLEGQAAREFIAWLVRGRGRREFPK

SEQ ID NO: 116 - protein, 38 aa, Artificial Sequence
  Description of Artificial Sequence: Synthetic polypeptide
HAEGTFTSDVSSYLEGQAAREFIAWLVRGRGRREFPEK

SEQ ID NO: 117 - protein, 39 aa, Artificial Sequence
  Description of Artificial Sequence: Synthetic polypeptide
HAEGTFTSDVSSYLEGQAAREFIAWLVRGRGRREFPEEK

SEQ ID NO: 118 - protein, 38 aa, Artificial Sequence
  Description of Artificial Sequence: Synthetic polypeptide
HDEFERHAEGTFTSDVSSYLEGQAAREFIAWLVRGRGK

SEQ ID NO: 119 - protein, 39 aa, Artificial Sequence
  Description of Artificial Sequence: Synthetic polypeptide
HDEFERHAEGTFTSDVSSYLEGQAAREFIAWLVRGRGRK

SEQ ID NO: 120 - protein, 40 aa, Artificial Sequence
  Description of Artificial Sequence: Synthetic polypeptide
HDEFERHAEGTFTSDVSSYLEGQAAREFIAWLVRGRGRRK

SEQ ID NO: 121 - protein, 41 aa, Artificial Sequence
  Description of Artificial Sequence: Synthetic polypeptide
HDEFERHAEGTFTSDVSSYLEGQAAREFIAWLVRGRGRREK

SEQ ID NO: 122 - protein, 42 aa, Artificial Sequence
  Description of Artificial Sequence: Synthetic polypeptide
HDEFERHAEGTFTSDVSSYLEGQAAREFIAWLVRGRGRREFK

SEQ ID NO: 123 - protein, 43 aa, Artificial Sequence
  Description of Artificial Sequence: Synthetic polypeptide
HDEFERHAEGTFTSDVSSYLEGQAAREFIAWLVRGRGRREFPK

SEQ ID NO: 124 - protein, 44 aa, Artificial Sequence
  Description of Artificial Sequence: Synthetic polypeptide
HDEFERHAEGTFTSDVSSYLEGQAAREFIAWLVRGRGRREFPEK

SEQ ID NO: 125 - protein, 45 aa, Artificial Sequence
  Description of Artificial Sequence: Synthetic polypeptide
HDEFERHAEGTFTSDVSSYLEGQAAREFIAWLVRGRGRREFPEEK

SEQ ID NO: 126 - protein, 38 aa, Artificial Sequence
  Description of Artificial Sequence: Synthetic polypeptide
DEFERHAEGTFTSDVSSYLEGQAAREFIAWLVRGRGRK

SEQ ID NO: 127 - protein, 39 aa, Artificial Sequence
  Description of Artificial Sequence: Synthetic polypeptide
DEFERHAEGTFTSDVSSYLEGQAAREFIAWLVRGRGRRK

SEQ ID NO: 128 - protein, 40 aa, Artificial Sequence
  Description of Artificial Sequence: Synthetic polypeptide
DEFERHAEGTFTSDVSSYLEGQAAREFIAWLVRGRGRREK

SEQ ID NO: 129 - protein, 41 aa, Artificial Sequence
  Description of Artificial Sequence: Synthetic polypeptide
DEFERHAEGTFTSDVSSYLEGQAAREFIAWLVRGRGRREFK

SEQ ID NO: 130 - protein, 42 aa, Artificial Sequence
  Description of Artificial Sequence: Synthetic polypeptide
DEFERHAEGTFTSDVSSYLEGQAAREFIAWLVRGRGRREFPK

SEQ ID NO: 131 - protein, 43 aa, Artificial Sequence
  Description of Artificial Sequence: Synthetic polypeptide
DEFERHAEGTFTSDVSSYLEGQAAREFIAWLVRGRGRREFPEK

SEQ ID NO: 132 - protein, 44 aa, Artificial Sequence
  Description of Artificial Sequence: Synthetic polypeptide
DEFERHAEGTFTSDVSSYLEGQAAREFIAWLVRGRGRREFPEEK

SEQ ID NO: 133 - protein, 36 aa, Artificial Sequence
  Description of Artificial Sequence: Synthetic polypeptide
EFERHAEGTFTSDVSSYLEGQAAREFIAWLVRGRGK

SEQ ID NO: 134 - protein, 37 aa, Artificial Sequence
  Description of Artificial Sequence: Synthetic polypeptide
EFERHAEGTFTSDVSSYLEGQAAREFIAWLVRGRGRK

SEQ ID NO: 135 - protein, 38 aa, Artificial Sequence
  Description of Artificial Sequence: Synthetic polypeptide
EFERHAEGTFTSDVSSYLEGQAAREFIAWLVRGRGRRK

SEQ ID NO: 136 - protein, 39 aa, Artificial Sequence
  Description of Artificial Sequence: Synthetic polypeptide
EFERHAEGTFTSDVSSYLEGQAAREFIAWLVRGRGRREK

SEQ ID NO: 137 - protein, 40 aa, Artificial Sequence
  Description of Artificial Sequence: Synthetic polypeptide
EFERHAEGTFTSDVSSYLEGQAAREFIAWLVRGRGRREFK

SEQ ID NO: 138 - protein, 41 aa, Artificial Sequence
  Description of Artificial Sequence: Synthetic polypeptide
EFERHAEGTFTSDVSSYLEGQAAREFIAWLVRGRGRREFPK

SEQ ID NO: 139 - protein, 42 aa, Artificial Sequence
  Description of Artificial Sequence: Synthetic polypeptide
EFERHAEGTFTSDVSSYLEGQAAREFIAWLVRGRGRREFPEK

SEQ ID NO: 140 - protein, 43 aa, Artificial Sequence
  Description of Artificial Sequence: Synthetic polypeptide
EFERHAEGTFTSDVSSYLEGQAAREFIAWLVRGRGRREFPEEK

SEQ ID NO: 141 - protein, 35 aa, Artificial Sequence
  Description of Artificial Sequence: Synthetic polypeptide
FERHAEGTFTSDVSSYLEGQAAREFIAWLVRGRGK

SEQ ID NO: 142 - protein, 36 aa, Artificial Sequence
  Description of Artificial Sequence: Synthetic polypeptide
FERHAEGTFTSDVSSYLEGQAAREFIAWLVRGRGRK

SEQ ID NO: 143 - protein, 37 aa, Artificial Sequence
  Description of Artificial Sequence: Synthetic polypeptide
FERHAEGTFTSDVSSYLEGQAAREFIAWLVRGRGRRK

SEQ ID NO: 144 - protein, 38 aa, Artificial Sequence
  Description of Artificial Sequence: Synthetic polypeptide
FERHAEGTFTSDVSSYLEGQAAREFIAWLVRGRGRREK

SEQ ID NO: 145 - protein, 39 aa, Artificial Sequence
  Description of Artificial Sequence: Synthetic polypeptide
FERHAEGTFTSDVSSYLEGQAAREFIAWLVRGRGRREFK

SEQ ID NO: 146 - protein, 40 aa, Artificial Sequence
  Description of Artificial Sequence: Synthetic polypeptide
FERHAEGTFTSDVSSYLEGQAAREFIAWLVRGRGRREFPK

SEQ ID NO: 147 - protein, 41 aa, Artificial Sequence
  Description of Artificial Sequence: Synthetic polypeptide
FERHAEGTFTSDVSSYLEGQAAREFIAWLVRGRGRREFPEK

SEQ ID NO: 148 - protein, 42 aa, Artificial Sequence
  Description of Artificial Sequence: Synthetic polypeptide
FERHAEGTFTSDVSSYLEGQAAREFIAWLVRGRGRREFPEEK

SEQ ID NO: 149 - protein, 34 aa, Artificial Sequence
  Description of Artificial Sequence: Synthetic polypeptide
ERHAEGTFTSDVSSYLEGQAAREFIAWLVRGRGK

SEQ ID NO: 150 - protein, 35 aa, Artificial Sequence
  Description of Artificial Sequence: Synthetic polypeptide
ERHAEGTFTSDVSSYLEGQAAREFIAWLVRGRGRK

SEQ ID NO: 151 - protein, 36 aa, Artificial Sequence
  Description of Artificial Sequence: Synthetic polypeptide
ERHAEGTFTSDVSSYLEGQAAREFIAWLVRGRGRRK

SEQ ID NO: 152 - protein, 37 aa, Artificial Sequence
  Description of Artificial Sequence: Synthetic polypeptide
ERHAEGTFTSDVSSYLEGQAAREFIAWLVRGRGRREK

SEQ ID NO: 153 - protein, 38 aa, Artificial Sequence
  Description of Artificial Sequence: Synthetic polypeptide
ERHAEGTFTSDVSSYLEGQAAREFIAWLVRGRGRREFK

SEQ ID NO: 154 - protein, 39 aa, Artificial Sequence
  Description of Artificial Sequence: Synthetic polypeptide
ERHAEGTFTSDVSSYLEGQAAREFIAWLVRGRGRREFPK

SEQ ID NO: 155 - protein, 40 aa, Artificial Sequence
  Description of Artificial Sequence: Synthetic polypeptide
ERHAEGTFTSDVSSYLEGQAAREFIAWLVRGRGRREFPEK

SEQ ID NO: 156 - protein, 41 aa, Artificial Sequence
  Description of Artificial Sequence: Synthetic polypeptide
ERHAEGTFTSDVSSYLEGQAAREFIAWLVRGRGRREFPEEK

SEQ ID NO: 157 - protein, 33 aa, Artificial Sequence
  Description of Artificial Sequence: Synthetic polypeptide
RHAEGTFTSDVSSYLEGQAAREFIAWLVRGRGK

SEQ ID NO: 158 - protein, 34 aa, Artificial Sequence
  Description of Artificial Sequence: Synthetic polypeptide
RHAEGTFTSDVSSYLEGQAAREFIAWLVRGRGRK

SEQ ID NO: 159 - protein, 35 aa, Artificial Sequence
  Description of Artificial Sequence: Synthetic polypeptide
RHAEGTFTSDVSSYLEGQAAREFIAWLVRGRGRRK

SEQ ID NO: 160 - protein, 36 aa, Artificial Sequence
  Description of Artificial Sequence: Synthetic polypeptide
RHAEGTFTSDVSSYLEGQAAREFIAWLVRGRGRREK

SEQ ID NO: 161 - protein, 37 aa, Artificial Sequence
  Description of Artificial Sequence: Synthetic polypeptide
RHAEGTFTSDVSSYLEGQAAREFIAWLVRGRGRREFK

SEQ ID NO: 162 - protein, 38 aa, Artificial Sequence
  Description of Artificial Sequence: Synthetic polypeptide
RHAEGTFTSDVSSYLEGQAAREFIAWLVRGRGRREFPK

SEQ ID NO: 163 - protein, 39 aa, Artificial Sequence
  Description of Artificial Sequence: Synthetic polypeptide
RHAEGTFTSDVSSYLEGQAAREFIAWLVRGRGRREFPEK

SEQ ID NO: 164 - protein, 40 aa, Artificial Sequence
  Description of Artificial Sequence: Synthetic polypeptide
RHAEGTFTSDVSSYLEGQAAREFIAWLVRGRGRREFPEEK

SEQ ID NO: 165 - protein, 38 aa, Artificial Sequence
  Description of Artificial Sequence: Synthetic polypeptide
HDEFERHAEGTFTSDVSSYLEGQAAREFIAWLVKGRGK

SEQ ID NO: 166 - protein, 38 aa, Artificial Sequence
  Description of Artificial Sequence: Synthetic polypeptide
HDEFERHAEGTFTSDVSSYLEGQAAKEFIAWLVRGRGK

SEQ ID NO: 167 - protein, 38 aa, Artificial Sequence
  Description of Artificial Sequence: Synthetic polypeptide
HDEFERHAEGTFTSDVSSYLEGQAAREFIAWLVRGKGK

SEQ ID NO: 168 - protein, 32 aa, Artificial Sequence
  Description of Artificial Sequence: Synthetic polypeptide
HAEGTFTSDVSSYLEGQAAREFIAWLVKGRGK

SEQ ID NO: 169 - protein, 32 aa, Artificial Sequence
  Description of Artificial Sequence: Synthetic polypeptide
HAEGTFTSDVSSYLEGQAAKEFIAWLVRGRGK

SEQ ID NO: 170 - protein, 32 aa, Artificial Sequence
  Description of Artificial Sequence: Synthetic polypeptide
HAEGTFTSDVSSYLEGQAAREFIAWLVRGKGK

SEQ ID NO: 171 - protein, 32 aa, Artificial Sequence; identical to SEQ ID NO: 110
  Description of Artificial Sequence: Synthetic polypeptide

SEQ ID NO: 172 - protein, 39 aa, Artificial Sequence
  Description of Artificial Sequence: Synthetic polypeptide
HDEFERHAEGTFTSDVSSYLEGQAAREFIAWLVKGRGRK

SEQ ID NO: 173 - protein, 39 aa, Artificial Sequence
  Description of Artificial Sequence: Synthetic polypeptide
HDEFERHAEGTFTSDVSSYLEGQAAKEFIAWLVRGRGRK

SEQ ID NO: 174 - protein, 39 aa, Artificial Sequence
  Description of Artificial Sequence: Synthetic polypeptide
HDEFERHAEGTFTSDVSSYLEGQAAREFIAWLVRGKGRK

SEQ ID NO: 175 - protein, 33 aa, Artificial Sequence; identical to SEQ ID NO: 94
  Description of Artificial Sequence: Synthetic polypeptide

SEQ ID NO: 176 - protein, 33 aa, Artificial Sequence
  Description of Artificial Sequence: Synthetic polypeptide
HAEGTFTSDVSSYLEGQAAKEFIAWLVRGRGRK

SEQ ID NO: 177 - protein, 33 aa, Artificial Sequence; identical to SEQ ID NO: 96
  Description of Artificial Sequence: Synthetic polypeptide

SEQ ID NO: 178 - protein, 32 aa, Artificial Sequence
  Description of Artificial Sequence: Synthetic polypeptide
HGEGTFTSDVSSYLEGQAAREFIAWLVKGRGK

SEQ ID NO: 179 - protein, 32 aa, Artificial Sequence
  Description of Artificial Sequence: Synthetic polypeptide
HGEGTFTSDVSSYLEGQAAREFIAWLVRGKGK

SEQ ID NO: 180 - protein, 38 aa, Artificial Sequence
  Description of Artificial Sequence: Synthetic polypeptide
FLFHYSKTQKLGKSNVVEELQSPFASQSRGYFLFRPRN

SEQ ID NO: 181 - protein, 33 aa, Homo sapiens; identical to SEQ ID NO: 35

SEQ ID NO: 182 - protein, 12 aa, Artificial Sequence
  Description of Artificial Sequence: Synthetic peptide
GESPGGSSGSES

SEQ ID NO: 183 - protein, 12 aa, Artificial Sequence
  Description of Artificial Sequence: Synthetic peptide
GSEGSSGPGESS

SEQ ID NO: 184 - protein, 12 aa, Artificial Sequence
  Description of Artificial Sequence: Synthetic peptide
GSSESGSSEGGP

SEQ ID NO: 185 - protein, 12 aa, Artificial Sequence
  Description of Artificial Sequence: Synthetic peptide
GSGGEPSESGSS

SEQ ID NO: 186 - protein, 12 aa, Artificial Sequence
  Description of Artificial Sequence: Synthetic peptide
GSPAGSPTSTEE

SEQ ID NO: 187 - protein, 12 aa, Artificial Sequence
  Description of Artificial Sequence: Synthetic peptide
GSEPATSGSETP

SEQ ID NO: 188 - protein, 12 aa, Artificial Sequence
  Description of Artificial Sequence: Synthetic peptide
GTSESATPESGP

SEQ ID NO: 189 - protein, 12 aa, Artificial Sequence
  Description of Artificial Sequence: Synthetic peptide
GTSTEPSEGSAP

SEQ ID NO: 190 - protein, 12 aa, Artificial Sequence
  Description of Artificial Sequence: Synthetic peptide
GSTSESPSGTAP

SEQ ID NO: 191 - protein, 12 aa, Artificial Sequence
  Description of Artificial Sequence: Synthetic peptide
GTSTPESGSASP

SEQ ID NO: 192 - protein, 12 aa, Artificial Sequence
  Description of Artificial Sequence: Synthetic peptide
GTSPSGESSTAP

SEQ ID NO: 193 - protein, 12 aa, Artificial Sequence
  Description of Artificial Sequence: Synthetic peptide
GSTSSTAESPGP

SEQ ID NO: 194 - protein, 12 aa, Artificial Sequence
  Description of Artificial Sequence: Synthetic peptide
GTPGSGTASSSP

SEQ ID NO: 195 - protein, 12 aa, Artificial Sequence
  Description of Artificial Sequence: Synthetic peptide
GSSTPSGATGSP

SEQ ID NO: 196 - protein, 12 aa, Artificial Sequence
  Description of Artificial Sequence: Synthetic peptide
GSSPSASTGTGP

SEQ ID NO: 197 - protein, 12 aa, Artificial Sequence
  Description of Artificial Sequence: Synthetic peptide
GASPGTSSTGSP

SEQ ID NO: 198 - protein, 12 aa, Artificial Sequence
  Description of Artificial Sequence: Synthetic peptide
GEPAGSPTSTSE

SEQ ID NO: 199 - protein, 12 aa, Artificial Sequence
  Description of Artificial Sequence: Synthetic peptide
GTGEPSSTPASE

SEQ ID NO: 200 - protein, 12 aa, Artificial Sequence
  Description of Artificial Sequence: Synthetic peptide
GSGPSTESAPTE

SEQ ID NO: 201 - protein, 12 aa, Artificial Sequence
  Description of Artificial Sequence: Synthetic peptide
GSETPSGPSETA

SEQ ID NO: 202 - protein, 12 aa, Artificial Sequence
  Description of Artificial Sequence: Synthetic peptide
GPSETSTSEPGA

SEQ ID NO: 203 - protein, 12 aa, Artificial Sequence
  Description of Artificial Sequence: Synthetic peptide
GSPSEPTEGTSA

SEQ ID NO: 204-221 - skipped (18 entries)

SEQ ID NO: 222 - protein, 8 aa, Artificial Sequence
  Description of Artificial Sequence: Synthetic peptide
LTPRSLLV

SEQ ID NO: 223 - protein, 8 aa, Artificial Sequence
  Description of Artificial Sequence: Synthetic peptide
LTPRSLLV

SEQ ID NO: 224 - protein, 8 aa, Artificial Sequence
  Description of Artificial Sequence: Synthetic peptide
KLTRVVGG

SEQ ID NO: 225 - protein, 8 aa, Artificial Sequence
  Description of Artificial Sequence: Synthetic peptide
TMTRIVGG

SEQ ID NO: 226 - protein, 8 aa, Artificial Sequence
  Description of Artificial Sequence: Synthetic peptide
SPFRSTGG

SEQ ID NO: 227 - protein, 8 aa, Artificial Sequence
  Description of Artificial Sequence: Synthetic peptide
LQVRIVGG

SEQ ID NO: 228 - protein, 8 aa, Artificial Sequence
  Description of Artificial Sequence: Synthetic peptide
PLGRIVGG

SEQ ID NO: 229 - protein, 8 aa, Artificial Sequence
  Description of Artificial Sequence: Synthetic peptide
IEGRTVGG

SEQ ID NO: 230 - protein, 8 aa, Artificial Sequence
  Description of Artificial Sequence: Synthetic peptide
LTPRSLLV

SEQ ID NO: 231 - protein, 8 aa, Artificial Sequence
  Description of Artificial Sequence: Synthetic peptide
LGPVSGVP

SEQ ID NO: 232 - protein, 8 aa, Artificial Sequence
  Description of Artificial Sequence: Synthetic peptide
VAGDSLEE

SEQ ID NO: 233 - protein, 8 aa, Artificial Sequence
  Description of Artificial Sequence: Synthetic peptide
GPAGLGGA

SEQ ID NO: 234 - protein, 8 aa, Artificial Sequence
  Description of Artificial Sequence: Synthetic peptide
GPAGLRGA

SEQ ID NO: 235 - protein, 8 aa, Artificial Sequence
  Description of Artificial Sequence: Synthetic peptide
APLGLRLR

SEQ ID NO: 236 - protein, 8 aa, Artificial Sequence
  Description of Artificial Sequence: Synthetic peptide
PALPLVAQ

SEQ ID NO: 237 - protein, 7 aa, Artificial Sequence
  Description of Artificial Sequence: Synthetic peptide
ENLYFQG

SEQ ID NO: 238 - protein, 8 aa, Artificial Sequence
  Description of Artificial Sequence: Synthetic peptide
DDDKIVGG

SEQ ID NO: 239 - protein, 8 aa, Artificial Sequence
  Description of Artificial Sequence: Synthetic peptide
LEVLFQGP

SEQ ID NO: 240 - protein, 8 aa, Artificial Sequence
  Description of Artificial Sequence: Synthetic peptide
LPKTGSES

SEQ ID NO: 241 - protein, 8 aa, Artificial Sequence
  Description of Artificial Sequence: Synthetic peptide
  MOD_RES (2)..(2): Pro or Ala
  MOD_RES (3)..(3): Any amino acid
  MOD_RES (6)..(6): Any amino acid
  MOD_RES (8)..(8): Any amino acid
GXXGLXGX

SEQ ID NO: 242 - protein, 8 aa, Artificial Sequence
  Description of Artificial Sequence: Synthetic peptide
  MOD_RES (3)..(3): Any amino acid
  MOD_RES (6)..(6): Any amino acid
  MOD_RES (7)..(7): Gly or Ala
  MOD_RES (8)..(8): Any amino acid
GPXGLXXX

SEQ ID NO: 243 - protein, 8 aa, Artificial Sequence
  Description of Artificial Sequence: Synthetic peptide
ENLYFQGS

SEQ ID NO: 244 - protein, 8 aa, Artificial Sequence
  Description of Artificial Sequence: Synthetic peptide
DDDKIVGG

SEQ ID NO: 245 - protein, 8 aa, Artificial Sequence
  Description of Artificial Sequence: Synthetic peptide
LEVLFQGP

SEQ ID NO: 246 - protein, 8 aa, Artificial Sequence
  Description of Artificial Sequence: Synthetic peptide
  MOD_RES (3)..(3): Lys, Glu, Ala or Asp
  MOD_RES (6)..(6): Any amino acid
  MOD_RES (7)..(7): Glu, Lys or Ser
LPXTGXXS

SEQ ID NO: 247-269 - skipped (23 entries)

SEQ ID NO: 270 - protein, 177 aa, Homo sapiens
MEICRGLRSHLITLLLFLFHSETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 271 - protein, 175 aa, Canis lupus familiaris
METCRCPLSYLISFLLFLPHSETACRLGKRPCRMQAFRIWDVNQKTFYLRNNQLVAGYLQGSNTKLEEKLDVVPVEPHAVFLGIHGGKLCLACVKSGDETRLQLEAVNITDLSKNKDQDKRFTFILSDSGPTTSFESAACPGWFLCTALEADRPVSLTNRPEEAMMVTKFYFQKE

SEQ ID NO: 272 - protein, 176 aa, Oryctolagus cuniculus
MRPSRSTRRHLISLLLFLFHSETACRPSGKRPCRMQAFRIWDVNQKTFYLRNNQLVAGYLQGPNAKLEERIDVVPLEPQLLFLGIQRGKLCLSCVKSGDKMKLHLEAVNITDLGKNKEQDKRFTFIRSNSGPTTTFESASCPGWFLCTALEADQPVSLTNTPDDSIVVTKFYFQED

SEQ ID NO: 273 - protein, 178 aa, Rattus norvegicus
MEICRGPYSHLISLLLILLFRSESAGHIPAGKRPCKMQAFRIWDTNQKTFYLRNNQLIAGYLQGPNTKLEEKIDMVPIDFRNVFLGIHGGKLCLSCVKSGDDTKLQLEEVNITDLNKNKEEDKRFTFIRSETGPTTSFESLACPGWFLCTTLEADHPVSLTNTPKEPCTVTKFYFQED

SEQ ID NO: 274 - protein, 178 aa, Mus musculus
MEICWGPYSHLISLLLILLFHSEAACRPSGKRPCKMQAFRIWDTNQKTFYLRNNQLIAGYLQGPNIKLEEKIDMVPIDLHSVFLGIHGGKLCLSCAKSGDDIKLQLEEVNITDLSKNKEEDKRFTFIRSEKGPTTSFESAACPGWFLCTTLEADRPVSLTNTPEEPLIVTKFYFQEDQ

SEQ ID NO: 275 - protein, 153 aa, Artificial Sequence
  Description of Artificial Sequence: Synthetic polypeptide
MRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 276 - protein, 178 aa, Unknown
  Description of Unknown: IL-10 sequence
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 277 - protein, 11 aa, Artificial Sequence
  Description of Artificial Sequence: Synthetic peptide
YGRKKRRQRRR

SEQ ID NO: 278 - protein, 12 aa, Artificial Sequence
  Description of Artificial Sequence: Synthetic peptide
RRQRRTSKLMKR

SEQ ID NO: 279 - protein, 27 aa, Artificial Sequence
  Description of Artificial Sequence: Synthetic peptide
GWTLNSAGYLLGKINLKALAALAKKIL

SEQ ID NO: 280 - protein, 33 aa, Artificial Sequence
  Description of Artificial Sequence: Synthetic polypeptide
KALAWEAKLAKALAKALAKHLAKALAKALKCEA

SEQ ID NO: 281 - protein, 16 aa, Artificial Sequence
  Description of Artificial Sequence: Synthetic peptide
RQIKIWFQNRRMKWKK

SEQ ID NO: 282 - protein, 11 aa, Artificial Sequence
  Description of Artificial Sequence: Synthetic peptide
YGRKKRRQRRR

SEQ ID NO: 283 - protein, 9 aa, Artificial Sequence
  Description of Artificial Sequence: Synthetic peptide
RKKRRQRRR

SEQ ID NO: 284 - protein, 11 aa, Artificial Sequence
  Description of Artificial Sequence: Synthetic peptide
YGRKKRRQRRR

SEQ ID NO: 285 - protein, 8 aa, Artificial Sequence
  Description of Artificial Sequence: Synthetic peptide
RKKRRQRR

SEQ ID NO: 286 - protein, 11 aa, Artificial Sequence
  Description of Artificial Sequence: Synthetic peptide
YARAAARQARA

SEQ ID NO: 287 - protein, 11 aa, Artificial Sequence
  Description of Artificial Sequence: Synthetic peptide
THRLPRRRRRR

SEQ ID NO: 288 - protein, 11 aa, Artificial Sequence
  Description of Artificial Sequence: Synthetic peptide
GGRRARRRRRR

SEQ ID NO: 289-675 - skipped (387 entries)

SEQ ID NO: 676 - protein, 144 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 677 - protein, 144 aa, Artificial Sequence
  Description of Artificial Sequence: Synthetic polypeptide
SPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPG

SEQ ID NO: 678 - protein, 144 aa, Artificial Sequence
  Description of Artificial Sequence: Synthetic polypeptide
TSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPG

SEQ ID NO: 679 - protein, 144 aa, Artificial Sequence; identical to SEQ ID NO: 678
  Description of Artificial Sequence: Synthetic polypeptide

SEQ ID NO: 680 - protein, 144 aa, Artificial Sequence
  Description of Artificial Sequence: Synthetic polypeptide
SPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPG

SEQ ID NO: 681 - protein, 144 aa, Artificial Sequence; identical to SEQ ID NO: 680
  Description of Artificial Sequence: Synthetic polypeptide

SEQ ID NO: 682 - protein, 144 aa, Artificial Sequence
  Description of Artificial Sequence: Synthetic polypeptide
TSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 683 - protein, 144 aa, Artificial Sequence; identical to SEQ ID NO: 682
  Description of Artificial Sequence: Synthetic polypeptide

SEQ ID NO: 684 - protein, 144 aa, Artificial Sequence
  Description of Artificial Sequence: Synthetic polypeptide
TSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEG

SEQ ID NO: 685 - protein, 144 aa, Artificial Sequence
  Description of Artificial Sequence: Synthetic polypeptide
TSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 686 - protein, 288 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 687 - protein, 288 aa, Artificial Sequence
  Description of Artificial Sequence: Synthetic polypeptide
GSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 688 - protein, 576 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 689 - protein, 625 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 690 - protein, 864 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 691 - protein, 865 aa, Artificial Sequence
  Description of Artificial Sequence: Synthetic polypeptide
GGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 692 - protein, 866 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 693 - protein, 1152 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 694 - protein, 144 aa, Artificial Sequence
  Description of Artificial Sequence: Synthetic polypeptide
STEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGS

SEQ ID NO: 695 - protein, 144 aa, Artificial Sequence
  Description of Artificial Sequence: Synthetic polypeptide
SEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPG

SEQ ID NO: 696 - protein, 180 aa, Artificial Sequence
  Description of Artificial Sequence: Synthetic polypeptide
TSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 697 - protein, 216 aa, Artificial Sequence
  Description of Artificial Sequence: Synthetic polypeptide
PESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 698 - protein, 252 aa, Artificial Sequence
  Description of Artificial Sequence: Synthetic polypeptide
ESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSE

SEQ ID NO: 699 - protein, 288 aa, Artificial Sequence
  Description of Artificial Sequence: Synthetic polypeptide
TPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 700 - protein, 324 aa, Artificial Sequence
  Description of Artificial Sequence: Synthetic polypeptide
PESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 701 - protein, 360 aa, Artificial Sequence
  Description of Artificial Sequence: Synthetic polypeptide
PESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 702 - protein, 360 aa, Artificial Sequence
  Description of Artificial Sequence: Synthetic polypeptide
PESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPS

SEQ ID NO: 703 - protein, 432 aa, Artificial Sequence
  Description of Artificial Sequence: Synthetic polypeptide
EGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 704 - protein, 468 aa, Artificial Sequence
  Description of Artificial Sequence: Synthetic polypeptide
EGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 705 - protein, 504 aa, Artificial Sequence
  Description of Artificial Sequence: Synthetic polypeptide
EGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 706 - protein, 540 aa, Artificial Sequence
  Description of Artificial Sequence: Synthetic polypeptide
TPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEP

SEQ ID NO: 707 - protein, 576 aa, Artificial Sequence
  Description of Artificial Sequence: Synthetic polypeptide
TPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 708 - protein, 612 aa, Artificial Sequence
  Description of Artificial Sequence: Synthetic polypeptide
GSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 709 - protein, 648 aa, Artificial Sequence
  Description of Artificial Sequence: Synthetic polypeptide
PESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 710 - protein, 684 aa, Artificial Sequence
  Description of Artificial Sequence: Synthetic polypeptide
EGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 711 - protein, 720 aa, Artificial Sequence
  Description of Artificial Sequence: Synthetic polypeptide
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTE

SEQ ID NO: 712 - protein, 756 aa, Artificial Sequence
  Description of Artificial Sequence: Synthetic polypeptide
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSES

SEQ ID NO: 713 - protein, 792 aa, Artificial Sequence
  Description of Artificial Sequence: Synthetic polypeptide
EGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 714 - protein, 828 aa, Artificial Sequence
  Description of Artificial Sequence: Synthetic polypeptide
PESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 715 - protein, 869 aa, Artificial Sequence
  Description of Artificial Sequence: Synthetic polypeptide
GSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGR

SEQ ID NO: 716 - protein, 144 aa, Artificial Sequence
  Description of Artificial Sequence: Synthetic polypeptide
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTESASR

SEQ ID NO: 717 - protein, 288 aa, Artificial Sequence
  Description of Artificial Sequence: Synthetic polypeptide
SAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASR

SEQ ID NO: 718 - protein, 432 aa, Artificial Sequence
  Description of Artificial Sequence: Synthetic polypeptide
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTESASR

SEQ ID NO: 719 - protein, 576 aa, Artificial Sequence
  Description of Artificial Sequence: Synthetic polypeptide
SAGSPTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASR

SEQ ID NO: 720 - protein, 864 aa, Artificial Sequence
  Description of Artificial Sequence: Synthetic polypeptide
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTESASR

SEQ ID NO: 721 - protein, 712 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEAHHH

SEQ ID NO: 722 - protein, 864 aa, Artificial Sequence
  Description of Artificial Sequence: Synthetic polypeptide
GSPGAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTESASR

SEQ ID NO: 723 - protein, 288 aa, Artificial Sequence
  Description of Artificial Sequence: Synthetic polypeptide
SPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPG

SEQ ID NO: 724 - protein, 284 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSE

SEQ ID NO: 725 - protein, 292 aa, Artificial Sequence
  Description of Artificial Sequence: Synthetic polypeptide
SPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 726 - protein, 864 aa, Artificial Sequence
  Description of Artificial Sequence: Synthetic polypeptide
AGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 727 - protein, 867 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 728 - protein, 867 aa, Artificial Sequence
  Description of Artificial Sequence: Synthetic polypeptide
SPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 729 - protein, 868 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 730 - protein, 144 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAP

SEQ ID NO: 731 - protein, 292 aa, Artificial Sequence; identical to SEQ ID NO: 725
  Description of Artificial Sequence: Synthetic polypeptide

SEQ ID NO: 732 - protein, 584 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGAAEPEA

SEQ ID NO: 733 - protein, 300 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGAAEPEA

SEQ ID NO: 734 - protein, 584 aa, Artificial Sequence; identical to SEQ ID NO: 732
  Description of Artificial Sequence: Synthetic polypeptide

SEQ ID NO: 735 - protein, 14 aa, Artificial Sequence
  Description of Artificial Sequence: Synthetic peptide
RSSNGAVTSSNYAN

SEQ ID NO: 736 - protein, 14 aa, Artificial Sequence
  Description of Artificial Sequence: Synthetic peptide
RSSNGEVTTSNYAN

SEQ ID NO: 737 - protein, 14 aa, Artificial Sequence
  Description of Artificial Sequence: Synthetic peptide
RSSTGAVTTSNYAN

SEQ ID NO: 738 - protein, 7 aa, Artificial Sequence
  Description of Artificial Sequence: Synthetic peptide
GTNKRAP

SEQ ID NO: 739 - protein, 7 aa, Artificial Sequence
  Description of Artificial Sequence: Synthetic peptide
GTIKRAP

SEQ ID NO: 740 - protein, 10 aa, Artificial Sequence
  Description of Artificial Sequence: Synthetic peptide
ALWYPNLWVF

SEQ ID NO: 741 - protein, 10 aa, Artificial Sequence
  Description of Artificial Sequence: Synthetic peptide
ALWYSNLWVF

SEQ ID NO: 742 - protein, 10 aa, Artificial Sequence
  Description of Artificial Sequence: Synthetic peptide
GFTFNTYAMN

SEQ ID NO: 743 - protein, 19 aa, Artificial Sequence
  Description of Artificial Sequence: Synthetic peptide
RIRSKYNNYATYYADSVKD

SEQ ID NO: 744 - protein, 14 aa, Artificial Sequence
  Description of Artificial Sequence: Synthetic peptide
HENFGNSYVSWFAH

SEQ ID NO: 745 - protein, 14 aa, Artificial Sequence
  Description of Artificial Sequence: Synthetic peptide
HGNFGNSYVSWFAY

SEQ ID NO: 746 - protein, 22 aa, Artificial Sequence
  Description of Artificial Sequence: Synthetic peptide
ELVVTQEPSLTVSPGGTVTLTC

SEQ ID NO: 747 - protein, 15 aa, Artificial Sequence
  Description of Artificial Sequence: Synthetic peptide
WVQQKPGQAPRGLIG

SEQ ID NO: 748 - protein, 32 aa, Artificial Sequence
  Description of Artificial Sequence: Synthetic polypeptide
GTPARFSGSLLGGKAALTLSGVQPEDEAVYYC

SEQ ID NO: 749 - protein, 32 aa, Artificial Sequence
  Description of Artificial Sequence: Synthetic polypeptide
GTPARFSGSSLGGKAALTLSGVQPEDEAVYYC

SEQ ID NO: 750 - protein, 32 aa, Artificial Sequence
  Description of Artificial Sequence: Synthetic polypeptide
GTPARFSGSLLGGSAALTLSGVQPEDEAVYYC

SEQ ID NO: 751 - protein, 32 aa, Artificial Sequence
  Description of Artificial Sequence: Synthetic polypeptide
GTPARFSGSSLGGSAALTLSGVQPEDEAVYYC

SEQ ID NO: 752 - protein, 32 aa, Artificial Sequence
  Description of Artificial Sequence: Synthetic polypeptide
GTPARFSGSLLGGKAALTLSGVQPEDEAEYYC

SEQ ID NO: 753 - protein, 32 aa, Artificial Sequence
  Description of Artificial Sequence: Synthetic polypeptide
GTPARFSGSSLGGSAALTLSGVQPEDEAEYYC

SEQ ID NO: 754 - protein, 9 aa, Artificial Sequence
  Description of Artificial Sequence: Synthetic peptide
GGGTKLTVL

SEQ ID NO: 755 - protein, 25 aa, Artificial Sequence
  Description of Artificial Sequence: Synthetic peptide
EVQLLESGGGIVQPGGSLKLSCAAS

SEQ ID NO: 756 - protein, 25 aa, Artificial Sequence
  Description of Artificial Sequence: Synthetic peptide
EVQLQESGGGIVQPGGSLKLSCAAS

SEQ ID NO: 757 - protein, 25 aa, Artificial Sequence
  Description of Artificial Sequence: Synthetic peptide
EVQLQESGGGLVQPGGSLKLSCAAS

SEQ ID NO: 758 - protein, 25 aa, Artificial Sequence
  Description of Artificial Sequence: Synthetic peptide
EVQLLESGGGLVQPGGSLKLSCAAS

SEQ ID NO: 759 - protein, 14 aa, Artificial Sequence
  Description of Artificial Sequence: Synthetic peptide
WVRQAPGKGLEWVA

SEQ ID NO: 760 - protein, 32 aa, Artificial Sequence
  Description of Artificial Sequence: Synthetic polypeptide
RFTISRDDSKNTVYLQMNNLKTEDTAVYYCVR

SEQ ID NO: 761 - skipped

SEQ ID NO: 762 - protein, 32 aa, Artificial Sequence
  Description of Artificial Sequence: Synthetic polypeptide
RFTISRDDSKNTAYLQMNNLKTEDTAVYYCVR

SEQ ID NO: 763 - skipped

SEQ ID NO: 764 - protein, 11 aa, Artificial Sequence
  Description of Artificial Sequence: Synthetic peptide
WGQGTLVTVSS

SEQ ID NO: 765 - protein, 109 aa, Artificial Sequence
  Description of Artificial Sequence: Synthetic polypeptide
ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVL

SEQ ID NO: 766 - protein, 125 aa, Artificial Sequence
  Description of Artificial Sequence: Synthetic polypeptide
EVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 767 - protein, 109 aa, Artificial Sequence
  Description of Artificial Sequence: Synthetic polypeptide
ELVVTQEPSLTVSPGGTVTLTCRSSNGEVTTSNYANWVQQKPGQAPRGLIGGTIKRAPGTPARFSGSLLGGKAALTLSGVQPEDEAVYYCALWYPNLWVFGGGTKLTVL

SEQ ID NO: 768 - protein, 109 aa, Artificial Sequence
  Description of Artificial Sequence: Synthetic polypeptide
ELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNLWVFGGGTKLTVL

SEQ ID NO: 769 - protein, 125 aa, Artificial Sequence
  Description of Artificial Sequence: Synthetic polypeptide
EVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 770 - protein, 109 aa, Artificial Sequence
  Description of Artificial Sequence: Synthetic polypeptide
ELVVTQEPSLTVSPGGTVTLTCRSSNGAVTSSNYANWVQQKPGQAPRGLIGGTNKRAPGTPARFSGSLLGGSAALTLSGVQPEDEAVYYCALWYPNLWVFGGGTKLTVL

SEQ ID NO: 771 - protein, 109 aa, Artificial Sequence
  Description of Artificial Sequence: Synthetic polypeptide
ELVVTQEPSLTVSPGGTVTLTCRSSNGAVTSSNYANWVQQKPGQAPRGLIGGTNKRAPGTPARFSGSSLGGSAALTLSGVQPEDEAVYYCALWYPNLWVFGGGTKLTVL

SEQ ID NO: 772 - protein, 109 aa, Artificial Sequence
  Description of Artificial Sequence: Synthetic polypeptide
ELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVL

SEQ ID NO: 773 - protein, 125 aa, Artificial Sequence
  Description of Artificial Sequence: Synthetic polypeptide
EVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 774 - protein, 109 aa, Artificial Sequence
  Description of Artificial Sequence: Synthetic polypeptide
ELVVTQEPSLTVSPGGTVTLTCRSSTGAVTTSNYANWVQQKPGQAPRGLIGGTNKRAPGTPARFSGSSLGGSAALTLSGVQPEDEAEYYCALWYSNLWVFGGGTKLTVL

SEQ ID NO: 775 - protein, 125 aa, Artificial Sequence
  Description of Artificial Sequence: Synthetic polypeptide
EVQLQESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 776 - protein, 264 aa, Artificial Sequence
  Description of Artificial Sequence: Synthetic polypeptide
ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 777 - protein, 264 aa, Artificial Sequence
  Description of Artificial Sequence: Synthetic polypeptide
ELVVTQEPSLTVSPGGTVTLTCRSSNGEVTTSNYANWVQQKPGQAPRGLIGGTIKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 778 - protein, 264 aa, Artificial Sequence
  Description of Artificial Sequence: Synthetic polypeptide
ELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 779 - protein, 264 aa, Artificial Sequence
  Description of Artificial Sequence: Synthetic polypeptide
ELVVTQEPSLTVSPGGTVTLTCRSSNGAVTSSNYANWVQQKPGQAPRGLIGGTNKRAPGTPARFSGSLLGGSAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 780 - protein, 264 aa, Artificial Sequence
  Description of Artificial Sequence: Synthetic polypeptide
ELVVTQEPSLTVSPGGTVTLTCRSSNGAVTSSNYANWVQQKPGQAPRGLIGGTNKRAPGTPARFSGSSLGGSAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 781 - protein, 264 aa, Artificial Sequence
  Description of Artificial Sequence: Synthetic polypeptide
ELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 782 - protein, 264 aa, Artificial Sequence
  Description of Artificial Sequence: Synthetic polypeptide
ELVVTQEPSLTVSPGGTVTLTCRSSTGAVTTSNYANWVQQKPGQAPRGLIGGTNKRAPGTPARFSGSSLGGSAALTLSGVQPEDEAEYYCALWYSNLWVFGGGTKLTVLGATPPETGAETESPGETTGGSAESEPPGEGEVQLQESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 783 - protein, 256 aa, Artificial Sequence
  Description of Artificial Sequence: Synthetic polypeptide
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGLWVFGGGTKLTVLGATPPETGAETESPGETTGGSAESEPPGEGQVQLQQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 784 - protein, 255 aa, Artificial Sequence
  Description of Artificial Sequence: Synthetic polypeptide
QAGLTQPPSASGTPGQRVTLSCSGSYSNIGTYYVYWYQQLPGTAPKLLIYSNDQRLSGVPDRFSGSKSGTSASLAISGLQSEDEAAYYCAAWDDSLNGWAFGGGTKLTVLGATPPETGAETESPGETTGGSAESEPPGEGQVQLQQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 785 - protein, 255 aa, Artificial Sequence
  Description of Artificial Sequence: Synthetic polypeptide
QPGLTQPPSASGTPGQRVTLSCSGRSSNIGSYYVYWYQHLPGMAPKLLIYRNSRRPSGVPDRFSGSKSGTSASLVISGLQSDDEADYYCAAWDDSLKSWVFGGGTKLTVLGATPPETGAETESPGETTGGSAESEPPGEGQVQLQQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 786 - protein, 255 aa, Artificial Sequence
  Description of Artificial Sequence: Synthetic polypeptide
QSVLTQPPSASGTPGQRVTISCSGSSSNIGTNYVYWYQQFPGTAPKLLIYSNNQRPSGVPDRFSGSKSGTSGSLAISGLQSEDEADYSCAAWDDSLNGWVFGGGTKLTVLGATPPETGAETESPGETTGGSAESEPPGEGQVQLVQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 787 - protein, 255 aa, Artificial Sequence
  Description of Artificial Sequence: Synthetic polypeptide
QPGLTQPPSASGTPGQRVTISCSGSSSNIGSNYVYWYQQLPGTAPKLLIYRNNQRPSGVPDRLSGSKSGTSASLAISGLRSEDEADYYCAAWDDSLSGWVFGGGTKLTVLGATPPETGAETESPGETTGGSAESEPPGEGQVQLVQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 788 - protein, 256 aa, Artificial Sequence
  Description of Artificial Sequence: Synthetic polypeptide
QAVLTQPPSASGTPGQRVTISCSGSSSNIGSYYVYWYQQVPGAAPKLLMRLNNQRPSGVPDRFSGAKSGTSASLVISGLRSEDEADYYCAAWDDSLSGQWVFGGGTKLTVLGATPPETGAETESPGETTGGSAESEPPGEGQVQLQQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 789 - protein, 255 aa, Artificial Sequence
  Description of Artificial Sequence: Synthetic polypeptide
QAGLTQPPSASGTPGQRVTISCSGSSSNIGSNYVYWYQQLPGTAPKLLIYRNNQRPSGVPDRFSGSKSGTSASLAISGLRSEDEADYYCATWDASLSGWVFGGGTKLTVLGATPPETGAETESPGETTGGSAESEPPGEGEVQLVQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 790-1714 - skipped (925 entries)

SEQ ID NO: 1715 - protein, 12 aa, Artificial Sequence
  Description of Artificial Sequence: Synthetic peptide
GSGASEPTSTEP

SEQ ID NO: 1716 - protein, 12 aa, Artificial Sequence
  Description of Artificial Sequence: Synthetic peptide
GSEPATSGTEPS

SEQ ID NO: 1717 - protein, 12 aa, Artificial Sequence
  Description of Artificial Sequence: Synthetic peptide
GTSEPSTSEPGA

SEQ ID NO: 1718 - protein, 12 aa, Artificial Sequence
  Description of Artificial Sequence: Synthetic peptide
GTSTEPSEPGSA

SEQ ID NO: 1719 - protein, 12 aa, Artificial Sequence
  Description of Artificial Sequence: Synthetic peptide
GSTAGSETSTEA

SEQ ID NO: 1720 - protein, 12 aa, Artificial Sequence
  Description of Artificial Sequence: Synthetic peptide
GSETATSGSETA

SEQ ID NO: 1721 - protein, 12 aa, Artificial Sequence
  Description of Artificial Sequence: Synthetic peptide
GTSESATSESGA

SEQ ID NO: 1722 - protein, 12 aa, Artificial Sequence
  Description of Artificial Sequence: Synthetic peptide
GTSTEASEGSAS

SEQ ID NO: 1723 - protein, 177 aa, Homo sapiens; identical to SEQ ID NO: 270

SEQ ID NO: 1724 - protein, 175 aa, Canis lupus familiaris; identical to SEQ ID NO: 271

SEQ ID NO: 1725 - protein, 176 aa, Oryctolagus cuniculus; identical to SEQ ID NO: 272

SEQ ID NO: 1726 - protein, 178 aa, Rattus norvegicus; identical to SEQ ID NO: 273

SEQ ID NO: 1727 - protein, 178 aa, Mus musculus; identical to SEQ ID NO: 274

SEQ ID NO: 1728 - protein, 153 aa, Artificial Sequence; identical to SEQ ID NO: 275
  Description of Artificial Sequence: Synthetic polypeptide

SEQ ID NO: 1729 - protein, 28 aa, Unknown
  Description of Unknown: a-natriuretic peptide (ANP)
SLRRSSCFGGRMDRIGAQSGLGCNSFRY

SEQ ID NO: 1730 - protein, 32 aa, Homo sapiens
SPKMVQGSGGFGRKMDRISSSSGLGCKVLRRH

SEQ ID NO: 1731 - protein, 32 aa, Rattus norvegicus
NSKMAHSSSCFGQKIDRIGAVSRLGCDGLRLF

SEQ ID NO: 1732 - protein, 22 aa, Sus scrofa
GLSKGCFGLKLDRIGSMSGLGC

SEQ ID NO: 1733 - protein, 146 aa, Unknown
  Description of Unknown: Fibroblast growth factor 2 (FGF-2) sequence
PALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKS

SEQ ID NO: 1734 - protein, 235 aa, Unknown
  Description of Unknown: TNF receptor (TNFR) sequence
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGD

SEQ ID NO: 1735 - protein, 461 aa, Unknown
  Description of Unknown: FIX precursor sequence
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1736 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1737 - protein, 460 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNFNAAINTYNHDIALLELDEPLVNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1738 - protein, 460 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNFNAAINTYNHDIALLELDEPLVNSYVTPICIADKEYTNIFLKFGSGYVSGWGRVFHKGRSALVLQYLRVPLVDRATCLRSTKFTIFNNMFCAGFHEGGRDSCQGDSGGPHVTEVEGTSFLTGIISWGEECAMKGKYGIYTKVSRYVNWIKEKTKLT

SEQ ID NO: 1739 - protein, 460 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNFNAAINTYNHDIALLELDEPLVLNSYVTPICIADKEYTNIFLKFGSGYVSGWGRVFHKGRSALVLQYLRVPLVDATCLRSTKFTIFNNMFCAGFHEGGRDSCQGDSGGPHVTEVEGTSFLTGIVSWGEGCAMKGKYGIYTKVSRYVNWIKEKTKLT

SEQ ID NO: 1740 - protein, 462 aa, Homo sapiens
MQRVNMIMAESPSLITICLLGYLLSAECTVFLDHENANKILNRPKRYNSGKLEEFVQGNLERECMEEKCSFEEPREVFENTEKITEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVDYVNPTEAETILDNITQGTQSFNDFTRVVGGEDAKPGQFPWQVVLNGKVDAFCGGSIVNEKWIVTAAHCVETGVKITVVAGEHNIEETEHTEQKRNVIRAIIPHHNYNAAINKYNHDIALLELDEPLVLNSYVTPICIADKEYTNIFLKFGSGYVSGWARVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1741 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDATCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1742 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDAPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1743 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDATCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDAPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1744 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDATCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLASTKFTIYNNMFCAGFHEGGRDSCQGDSGGPHVTEVEGTSFLTGIISWGEECAMKGKYGIYTKVSRYVNWIKEKTKLT

SEQ ID NO: 1745 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDAPLVLNSYVTPICIADKEYTNIFLKFGSGYVSGWGRVFHKGRSALVLQYLRVPLVDRATCLASTKFTIYNNMFCAGFHEGGRDSCQGDSGGPHVTEVEGTSFLTGIISWGEECAMKGKYGIYTKVSRYVNWIKEKTKLT

SEQ ID NO: 1746 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDATCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDAPLVLNSYVTPICIADKEYTNIFLKFGSGYVSGWGRVFHKGRSALVLQYLRVPLVDRATCLASTKFTIYNNMFCAGFHEGGRDSCQGDSGGPHVTEVEGTSFLTGIISWGEECAMKGKYGIYTKVSRYVNWIKEKTKLT

SEQ ID NO: 1747 - protein, 406 aa, Unknown [sequence omitted]

SEQ ID NO: 1748-1749 - skipped (2 entries)

SEQ ID NO: 1750 - protein, 191 aa, Homo sapiens [sequence omitted]

SEQ ID NO: 1751 - protein, 190 aa, Sus scrofa
FPAMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 1752 - protein, 190 aa, Vicugna pacos
FPAMPLSSLFANAVLRAQHLHQLAADTYKEFERTYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILRQTYDKFDTNLRSDDALLKNYGLLSCFKKDLHKAETYLRVMKCRRFVESSCAF

SEQ ID NO: 1753 - protein, 190 aa, Camelus sp.; identical to SEQ ID NO: 1752

SEQ ID NO: 1754 - protein, 190 aa, Equus sp.
FPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVFGTSDRVYEKLRDLEEGIQALMRELEDGSPRAGQILKQTYDKFDTNLRSDDALLKNYGLLSCFKKDLHKAETYLRVMKCRRFVESSCAF

SEQ ID NO: 1755 - protein, 190 aa, Loxodonta sp.
FPAMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRPGQVLKQTYDKFDTNMRSDDALLKNYGLLSCFKKDLHKAETYLRVMKCRRFVESSCAF

SEQ ID NO: 1756 - protein, 190 aa, Vulpes vulpes
FPAMPLSSLFANAVLRAQHLHQLAADTYKEFERAYIPEGQRYSIQNAQAAFCFSETIPAPTGKDEAQQRSDVELLRFSLVLIQSWLGPLQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 1757 - protein, 190 aa, Canis lupus familiaris; identical to SEQ ID NO: 1751

SEQ ID NO: 1758 - protein, 190 aa, Felis catus
FPAMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRGGQILKQTYDKFDTNLRSDDALLKNYGLLSCFKKDLHKAETYLRVMKCRRFVESSCAF

SEQ ID NO: 1759 - protein, 190 aa, Neovison vison
FPAMPLSSLFANAVLRAQHLHQLAADTYKDFERAYIPEGQRYSIQNAQAAFCFSETIPAPTGKDEAQQRSDMELLRFSLLLIQSWLGPVQFLSRVFTNSLVFGTSDRVYEKLKDLEEGIQALMRELEDGSPRAGPILKQTYDKFDTNLRSDDALLKNYGLLSCFKKDLHKAETYLRVMKCRRFVESSCAF

SEQ ID NO: 1760 - protein, 190 aa, Balaenoptera sp.
FPAMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNMRSDDALLKNYGLLSCFKKDLHKAETYLRVMKCRRFVESSCAF

SEQ ID NO: 1761 - protein, 190 aa, Delphinus sp.
FPAMPLSSLFANAVLRAQHLHQLAADTYKEFERAYIPEGQRYSIQNTQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNMRSDDALLKNYGLLSCFKKDLHKAETYLRVMKCRRFVESSCAF

SEQ ID NO: 1762 - protein, 190 aa, Hippopotamus amphibius; identical to SEQ ID NO: 1761

SEQ ID NO: 1763 - protein, 190 aa, Oryctolagus cuniculus
FPAMPLSSLFANAVLRAQHLHQLAADTYKEFERAYIPEGQRYSIQNAQAAFCFSETIPAPTGKDEAQQRSDMELLRFSLLLIQSWLGPVQFLSRAFTNTLVFGTSDRVYEKLKDLEEGIQALMRELEDGSPRVGQLLKQTYDKFDTNLRGDDALLKNYGLLSCFKKDLHKAETYLRVMKCRRFVESSCVF

SEQ ID NO: 1764 - protein, 190 aa, Rattus norvegicus
FPAMPLSSLFANAVLRAQHLHQLAADTYKEFERAYIPEGQRYSIQNAQAAFCFSETIPAPTGKEEAQQRTDMELLRFSLLLIQSWLGPVQFLSRIFTNSLMFGTSDRVYEKLKDLEEGIQALMQELEDGSPRIGQILKQTYDKFDANMRSDDALLKNYGLLSCFKKDLHKAETYLRVMKCRRFAESSCAF

SEQ ID NO: 1765 - protein, 190 aa, Mus musculus
FPAMPLSSLFSNAVLRAQHLHQLAADTYKEFERAYIPEGQRYSIQNAQAAFCFSETIPAPTGKEEAQQRTDMELLRFSLLLIQSWLGPVQFLSRIFTNSLMFGTSDRVYEKLKDLEEGIQALMQELEDGSPRVGQILKQTYDKFDANMRSDDALLKNYGLLSCFKKDLHKAETYLRVMKCRRFVESSCAF

SEQ ID NO: 1766 - protein, 190 aa, Mesocricetus auratus
FPAMPLSSLFANAVLRAQHLHQLAADTYKEFERAYIPEGQRYSIQNAQTAFCFSETIPAPTGKEEAQQRSDMELLRFSLLLIQSWLGPVQFLSRIFTNSLMFGTSDRVYEKLKDLEEGIQALMQELEDGSPRVGQILKQTYDKFDTNMRSDDALLKNYGLLSCFKKDLHKAETYLRVMKCRRFVESSCAF

SEQ ID NO: 1767 - protein, 190 aa, Nannospalax ehrenbergi
FPAMPLSNLFANAVLRAQHLHQLAADTYKEFERAYIPEGQRYSIQNAQAAFCFSETIPAPTGKEEAQQRSDMELLRFSLLLIQSWLGPVQFLSRVFTNSLVFGTSDRVFEKLKDLEEGIQALMRELEDGSLRAGQLLKQTYDKFDTNMRSDDALLKNYGLLSCFKKDLHKAETYLRVMKCRRFVESSCAF

SEQ ID NO: 1768 - protein, 190 aa, Cavia porcellus
FPAMPLSSLFGNAVLRAQHLHQLAADTYKEFERTYIPEGQRYSIHNTQTAFCFSETIPAPTDKEEAQQRSDVELLHFSLLLIQSWLGPVQFLSRVFTNSLVFGTSDRVYEKLKDLEEGIQALMRELEDGTPRAGQILKQTYDKFDTNLRSNDALLKNYGLLSCFRKDLHRTETYLRVMKCRRFVESSCAF

SEQ ID NO: 1769 - protein, 191 aa, Bos taurus
AFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 1770 - protein, 191 aa, Unknown
  Description of Unknown: Sheep/Goat sequence
AFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDVTPRAGQILKQTYDKFDTNMRSDDALLKNYGLLSCFRKDLHKTETYLRVMKCRRFGEASCAF

SEQ ID NO: 1771 - protein, 190 aa, Cervus elaphus
FPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 1772 - protein, 191 aa, Giraffa camelopardalis
AFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFSNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 1773 - protein, 190 aa, Tragulus javanicus
FPAMSLSGLFANAVLRVQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGPPRAGQILKQTYDKFDTNMRSDDALLKNYGLLSCFRKDLHKTETYLRVMKCRRFGEASCAF

SEQ ID NO: 1774 - protein, 190 aa, Nycticebus pygmaeus
FPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVLGTSDRVYEKLKDLEEGIQALMRELEDGSPRVGQILKQTYDKFDTNLRSDDALLKNYGLLSCFKKDLHKAETYLRVMKCRRFVESSCAF

SEQ ID NO: 1775 - protein, 191 aa, Callithrix jacchus
FPTIPLSRLLDNAMLRAHRLHQLAFDTYQEFEEAYIPKEQKYSFLQNPQTSLCFSESIPTPASKKETQQKSNLELLRMSLLLIQSWFEPVQFLRSVFANSLLYGVSDSDVYEYLKDLEEGIQTLMGRLEDGSPRTGEIFMQTYRKFDVNSQNNDALLKNYGLLYCFRKDMDKVETFLRIVQCRSVEGSCGF

SEQ ID NO: 1776 - protein, 190 aa, Trichosurus vulpecula
FPAMPLSSLFANAVLRAQHLHQLVADTYKEFERTYIPEAQRHSIQSTQTAFCFSETIPAPTGKDEAQQRSDVELLRFSLLLIQSWLSPVQFLSRVFTNSLVFGTSDRVYEKLRDLEEGIQALMQELEDGSSRGGLVLKTTYDKFDTNLRSDEALLKNYGLLSCFKKDLHKAETYLRVMKCRRFVESSCAF

SEQ ID NO: 1777 - protein, 191 aa, Macaca mulatta
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGTSYSDVYDLLKDLEEGIQTLMGRLEDGSSRTGQIFKQTYSKFDTNSHNNDALLKNYGLLYCFRKDMDKIETFLRIVQCRSVEGSCGF

SEQ ID NO: 1778-8000 - skipped (6223 entries)

SEQ ID NO: 8001 - protein, 874 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGFTABTSESATPESGPGSEPATSGPTESGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 8002 - protein, 870 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGPTESGSEPATSGSETPGSPAGSPTSTEEGTSTEPSEGSAPGTSTEPSEGSAPGSEPATSGSETPGTSESATPESGPGTSTEPSEGSAPGEPEA

SEQ ID NO: 8003 - protein, 870 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 8004 - protein, 294 aa, Artificial Sequence
  Description of Artificial Sequence: Synthetic polypeptide
ASSPAGSPTSTESGTSESATPESGPGTETEPSEGSAPGTSESATPESGPGSEPATSGSETPGTSESATPESGPGSTPAESGSETPGTSESATPESGPGTSTEPSEGSAPGSPAGSPTSTEEGTSESATPESGPGESPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8005 - protein, 294 aa, Artificial Sequence
  Description of Artificial Sequence: Synthetic polypeptide
ASSPAGSPTSTESGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGESPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8006 - protein, 294 aa, Artificial Sequence
  Description of Artificial Sequence: Synthetic polypeptide
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGEEPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8007 - protein, 294 aa, Artificial Sequence
  Description of Artificial Sequence: Synthetic polypeptide
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8008 - protein, 866 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPG

SEQ ID NO: 8009 - protein, 578 aa, Artificial Sequence
  Description of Artificial Sequence: Synthetic polypeptide
PGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPG

SEQ ID NO: 8010 - protein, 1152 aa, Artificial Sequence
  Description of Artificial Sequence: Synthetic polypeptide
SAGSPGSPAGSPTSTEEGTSESATPESGPGTSTEPSEGSAPGSPAGSPTSTEEGTSTEPSEGSAPGTSTEPSEGSAPGTSESATPESGPGSTPAESGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSTETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTESAS

SEQ ID NO: 8011 - protein, 1153 aa, Artificial Sequence
  Description of Artificial Sequence: Synthetic polypeptide
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSTETPGSPAGSPTSTEEGTSESATPESGPGTSTEPSEGSAPGTSTEPSEGSAPGSPAGSPTSTEEGTSTEPSEGSAPGTATESPEGSAPGTSESATPESGPGTSTEPSEGSAPGTSAESATPESGPGSEPATSGSETPGTSTEPSEGSAPGTSTEPSEGSAPGTSESATPESGPGTESAS

SEQ ID NO: 8012 - protein, 864 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPATSESATPESGPGSEPATSGSETPGSEPATSGSETPGSPAGSPTSTEEGTSESASPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 8013 - protein, 864 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSESATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 8014 - protein, 292 aa, Artificial Sequence
  Description of Artificial Sequence: Synthetic polypeptide
SPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8015 - protein, 582 aa, Artificial Sequence
  Description of Artificial Sequence: Synthetic polypeptide
PGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 8016 - protein, 576 aa, Artificial Sequence
  Description of Artificial Sequence: Synthetic polypeptide
TPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSESATSGSETPGSPAGSPTSTEEGTSTEPSEGSAPGTSTEPSEGSAPGSEPATSGSETPGTSESA

SEQ ID NO: 8017 - protein, 576 aa, Artificial Sequence
  Description of Artificial Sequence: Synthetic polypeptide
GTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESASPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGP

SEQ ID NO: 8018 - protein, 576 aa, Artificial Sequence
  Description of Artificial Sequence: Synthetic polypeptide
GSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSTETGTSESATPESGPGSEPATSGSETPGTSESATPESGPGTSTEPSEGSAPGSPAGSPTSTEEGTSESATPESGPGSEPATS

SEQ ID NO: 8019 - protein, 576 aa, Artificial Sequence
  Description of Artificial Sequence: Synthetic polypeptide
EGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESASPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESAT

SEQ ID NO: 8020 - protein, 10 aa, Artificial Sequence
  Description of Artificial Sequence: Synthetic peptide
SPATSGSTPE

SEQ ID NO: 8021 - protein, 8 aa, Artificial Sequence
  Description of Artificial Sequence: Synthetic peptide
GSAPATSE

SEQ ID NO: 8022 - protein, 9 aa, Artificial Sequence
  Description of Artificial Sequence: Synthetic peptide
GSAPGTATE

SEQ ID NO: 8023 - protein, 7 aa, Artificial Sequence
  Description of Artificial Sequence: Synthetic peptide
GSAPGTE

SEQ ID NO: 8024 - protein, 8 aa, Artificial Sequence
  Description of Artificial Sequence: Synthetic peptide
PATSGPTE

SEQ ID NO: 8025 - protein, 5 aa, Artificial Sequence
  Description of Artificial Sequence: Synthetic peptide
SASPE

SEQ ID NO: 8026 - protein, 8 aa, Artificial Sequence
  Description of Artificial Sequence: Synthetic peptide
PATSGSTE

SEQ ID NO: 8027 - protein, 9 aa, Artificial Sequence
  Description of Artificial Sequence: Synthetic peptide
GSAPGTSAE

SEQ ID NO: 8028 - protein, 7 aa, Artificial Sequence
  Description of Artificial Sequence: Synthetic peptide
SATSGSE

SEQ ID NO: 8029 - protein, 9 aa, Artificial Sequence
  Description of Artificial Sequence: Synthetic peptide
SGPGSTPAE

SEQ ID NO: 8030 - protein, 4 aa, Artificial Sequence
  Description of Artificial Sequence: Synthetic peptide
SGSE

SEQ ID NO: 8031 - protein, 6 aa, Artificial Sequence
  Description of Artificial Sequence: Synthetic 6xHis tag
HHHHHH

SEQ ID NO: 8032 - protein, 8 aa, Artificial Sequence
  Description of Artificial Sequence: Synthetic 8xHis tag
HHHHHHHH

SEQ ID NO: 8033 - protein, 4 aa, Artificial Sequence
  Description of Artificial Sequence: Synthetic peptide
EPEA

SEQ ID NO: 8034 - protein, 11 aa, Artificial Sequence
  Description of Artificial Sequence: Synthetic peptide
RASQDIRNYLN

SEQ ID NO: 8035 - protein, 7 aa, Artificial Sequence
  Description of Artificial Sequence: Synthetic peptide
YTSRLES

SEQ ID NO: 8036 - protein, 9 aa, Artificial Sequence
  Description of Artificial Sequence: Synthetic peptide
QQGNTLPWT

SEQ ID NO: 8037 - protein, 10 aa, Artificial Sequence
  Description of Artificial Sequence: Synthetic peptide
GYSFTGYTMN

SEQ ID NO: 8038 - protein, 10 aa, Artificial Sequence
  Description of Artificial Sequence: Synthetic peptide
LINPYKGVST

SEQ ID NO: 8039 - protein, 13 aa, Artificial Sequence
  Description of Artificial Sequence: Synthetic peptide
SGYYGDSDWYFDV

SEQ ID NO: 8040 - protein, 119 aa, Artificial Sequence [sequence omitted]

SEQ ID NO: 8041 - protein, 122 aa, Artificial Sequence [sequence omitted]

SEQ ID NO: 8042 - protein, 119 aa, Artificial Sequence
  Description of Artificial Sequence: Synthetic polypeptide
QVQLVQSGGGVVQPGRSLRLSCKASGYTFTSYTMHWVRQAPGKGLEWIGYINPSSGYTKYNQKFKDRFTISADKSKSTAFLQMDSLRPEDTGVYFCARWQDYDVYFDYWGQGTPVTVSS

SEQ ID NO: 8043 - protein, 119 aa, Artificial Sequence [sequence omitted]

SEQ ID NO: 8044 - protein, 119 aa, Artificial Sequence
  Description of Artificial Sequence: Synthetic polypeptide
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 8045 - protein, 119 aa, Artificial Sequence
  Description of Artificial Sequence: Synthetic polypeptide
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 8046 - protein, 125 aa, Artificial Sequence
  Description of Artificial Sequence: Synthetic polypeptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 8047 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 8048 - protein, 125 aa, Artificial Sequence
  Description of Artificial Sequence: Synthetic polypeptide
EVKLLESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSS

SEQ ID NO: 8049 - protein, 107 aa, Artificial Sequence
  Description of Artificial Sequence: Synthetic polypeptide
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITR

SEQ ID NO: 8050 - protein, 107 aa, Artificial Sequence [sequence omitted]

SEQ ID NO: 8051 - protein, 107 aa, Artificial Sequence
  Description of Artificial Sequence: Synthetic polypeptide
DIQMTQSPSSLSASVGDRVTMTCRASSSVSYMHWYQQTPGKAPKPWIYATSNLASGVPSRFSGSGSGTDYTLTISSLQPEDIATYYCQQWSSNPPTFGQGTKLQITR

SEQ ID NO: 8052 - protein, 107 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 8053 - protein, 106 aa, Artificial Sequence
  Description of Artificial Sequence: Synthetic polypeptide
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 8054 - protein, 106 aa, Artificial Sequence
  Description of Artificial Sequence: Synthetic polypeptide
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 8055 - protein, 109 aa, Artificial Sequence
  Description of Artificial Sequence: Synthetic polypeptide
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 8056 - protein, 109 aa, Artificial Sequence
  Description of Artificial Sequence: Synthetic polypeptide
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 8057 - protein, 109 aa, Artificial Sequence
  Description of Artificial Sequence: Synthetic polypeptide
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 8058 - protein, 30 aa, Artificial Sequence
  Description of Artificial Sequence: Synthetic polypeptide
GSGEGSEGEGGGEGSEGEGSGEGGEGEGSG

SEQ ID NO: 8059 - protein, 32 aa, Artificial Sequence
  Description of Artificial Sequence: Synthetic polypeptide
TGSGEGSEGEGGGEGSEGEGSGEGGEGEGSGT

SEQ ID NO: 8060 - protein, 30 aa, Artificial Sequence
  Description of Artificial Sequence: Synthetic polypeptide
GATPPETGAETESPGETTGGSAESEPPGEG

SEQ ID NO: 8061 - protein, 30 aa, Artificial Sequence
  Description of Artificial Sequence: Synthetic polypeptide
GSAAPTAGTTPSASPAPPTGGSSAAGSPST

SEQ ID NO: 8062 - protein, 6 aa, Artificial Sequence
  Description of Artificial Sequence: Synthetic peptide
SGGGGS

SEQ ID NO: 8063 - protein, 5 aa, Artificial Sequence
  Description of Artificial Sequence: Synthetic peptide
GGGGS

SEQ ID NO: 8064 - protein, 6 aa, Artificial Sequence
  Description of Artificial Sequence: Synthetic peptide
GGSGGS

SEQ ID NO: 8065 - protein, 123 aa, Artificial Sequence [sequence omitted]

SEQ ID NO: 8066 - protein, 122 aa, Artificial Sequence
  Description of Artificial Sequence: Synthetic polypeptide
EVQLVESGGGLVQPGGSLRLSCAASGFTFSSYDIHWVRQATGKGLEWVSAIGPAGDTYYPGSVKGRFTISRENAKNSLYLQMNSLRAGDTAVYYCARGLITFGGLIAPFDYWGQGTLVTVSS

SEQ ID NO: 8067 - protein, 120 aa, Artificial Sequence
  Description of Artificial Sequence: Synthetic polypeptide
QVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSS

SEQ ID NO: 8068 - protein, 121 aa, Artificial Sequence
  Description of Artificial Sequence: Synthetic polypeptide
EVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSS

SEQ ID NO: 8069 - protein, 121 aa, Artificial Sequence
  Description of Artificial Sequence: Synthetic polypeptide
EVQLVESGGGLVQPGGSLRLSCAASGFNIKDTYMHWVRQAPGKGLEWVARIDPANGNSKYVPKFQGRATISADTSKNTAYLQMNSLRAEDTAVYYCAPFGYYVSDYAMAYWGQGTLVTVSS

SEQ ID NO: 8070 - protein, 119 aa, Artificial Sequence
  Description of Artificial Sequence: Synthetic polypeptide
EVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSS

SEQ ID NO: 8071 - protein, 121 aa, Artificial Sequence
  Description of Artificial Sequence: Synthetic polypeptide
EVKLVESGGGLVQPGGSLRLSCATSGFTFTDYYMNWVRQPPGKALEWLGFIGNKANGYTTEYSASVKGRFTISRDKSQSILYLQMNTLRAEDSATYYCTRDRGLRFYFDYWGQGTTLTVSS

SEQ ID NO: 8072 - protein, 121 aa, Artificial Sequence
  Description of Artificial Sequence: Synthetic polypeptide
EVQLVESGGGLVQPGRSLRLSCAASGFTVSSYWMHWVRQAPGKGLEWVGFIRNKANGGTTEYAASVKGRFTISRDDSKNTLYLQMNSLRAEDTAVYYCARDRGLRFYFDYWGQGTTVTVSS

SEQ ID NO: 8073 - protein, 124 aa, Artificial Sequence
  Description of Artificial Sequence: Synthetic polypeptide
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 8074 - protein, 122 aa, Artificial Sequence
  Description of Artificial Sequence: Synthetic polypeptide
EVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 8075 - protein, 122 aa, Artificial Sequence
  Description of Artificial Sequence: Synthetic polypeptide
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSG

SEQ ID NO: 8076 - protein, 119 aa, Artificial Sequence
  Description of Artificial Sequence: Synthetic polypeptide
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 8077 - protein, 122 aa, Artificial Sequence [sequence omitted]

SEQ ID NO: 8078 - protein, 121 aa, Artificial Sequence [sequence omitted]

SEQ ID NO: 8079 - protein, 122 aa, Artificial Sequence [sequence omitted]

SEQ ID NO: 8080 - protein, 114 aa, Artificial Sequence
  Description of Artificial Sequence: Synthetic polypeptide
QLVQSGAEVKKPGSSVKVSCKASGYTITDSNIHWVRQAPGQSLEWIGYIYPYNGGTDYNQKFKNRATLTVDNPTNTAYMELSSLRSEDTDFYYCVNGNPWLAYWGQGTLVTVSS

SEQ ID NO: 8081 - protein, 122 aa, Artificial Sequence [sequence omitted]

SEQ ID NO: 8082 - protein, 118 aa, Artificial Sequence
  Description of Artificial Sequence: Synthetic polypeptide
QIQLVQSGPEVKKPGETVKISCKASGYTFTNYGMNWVKQAPGKGLKWMGWINTYTGEPTYADAFKGRFAFSLETSASTAYLQINNLKNEDTATYFCARDYGDYGMDYWGQGTSVTVSS

SEQ ID NO: 8083 - protein, 118 aa, Artificial Sequence
  Description of Artificial Sequence: Synthetic polypeptide
QVQLQQSGTELMTPGASVTMSCKTSGYTFSTYWIEWVKQRPGHGLEWIGEILGPSGYTDYNEKFKAKATFTADTSSNTAYMQLSSLASEDSAVYYCARWDRLYAMDYWGGGTSVTVSS

SEQ ID NO: 8084 - protein, 118 aa, Artificial Sequence
  Description of Artificial Sequence: Synthetic polypeptide
QVQLVESGGGVVQPGRSLRLSCAASGFTFSSYIMHWVRQAPGKGLEWVAVISYDGRNKYYADSVKGRFTISRDNSKNTLYLQMNSLRAEDTAVYYCARDTDGYDFDYWGQGTLVTVSS

SEQ ID NO: 8085 - protein, 119 aa, Artificial Sequence
  Description of Artificial Sequence: Synthetic polypeptide
QIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSS

SEQ ID NO: 8086 - protein, 118 aa, Artificial Sequence
  Description of Artificial Sequence: Synthetic polypeptide
QVQLVESGGGVVQPGRSLRLSCATSGFTFSDYGMHWVRQAPGKGLEWVAVIWYDGSNKYYADSVKGRFTISRDNSKKTLSLQMNSLRAEDTAVYYCARDSIMVRGDYWGQGTLVTVSS

SEQ ID NO: 8087 - protein, 118 aa, Artificial Sequence
  Description of Artificial Sequence: Synthetic polypeptide
QVQLVESGGGVVQPGRSLRLSCAASGFTFSDHGMHWVRQAPGKGLEWVAVIWYDGSNKYYADSVKGRFTISRDNSKNTLYLQMNSLRAEDTAVYYCARDSIMVRGDYWGQGTLVTVSS

SEQ ID NO: 8088 - protein, 122 aa, Artificial Sequence
  Description of Artificial Sequence: Synthetic polypeptide
QVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSS

SEQ ID NO: 8089 - protein, 117 aa, Artificial Sequence
  Description of Artificial Sequence: Synthetic polypeptide
QVQLVQSGAEVKKPGASVKVSCKASGYTFTSYGFSWVRQAPGQGLEWMGWISASNGNTYYAQKLQGRVTMTTDTSTSTAYMELRSLRSDDTAVYYCARVYADYADYWGQGTLVTVSS

SEQ ID NO: 8090 - protein, 115 aa, Artificial Sequence [sequence omitted]

SEQ ID NO: 8091 - protein, 119 aa, Artificial Sequence [sequence omitted]

SEQ ID NO: 8092 - protein, 125 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSS

SEQ ID NO: 8093 - protein, 118 aa, Artificial Sequence
  Description of Artificial Sequence: Synthetic polypeptide
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 8094 - protein, 123 aa, Artificial Sequence
  Description of Artificial Sequence: Synthetic polypeptide
QVQLQESGPGLVKPSQTLSLTCTVSGGSISSGGYYWSWIRQHPGKGLEWIGIIYYSGSTYYNPSLKSRVTISVDTSKNQFSLKLNSVTAADTAVFYCARVAIVTTIPGGMDVWGQGTTVTVSS

SEQ ID NO: 8095 - protein, 120 aa, Artificial Sequence
  Description of Artificial Sequence: Synthetic polypeptide
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSS

SEQ ID NO: 8096 - protein, 127 aa, Artificial Sequence
  Description of Artificial Sequence: Synthetic polypeptide
EVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSS

SEQ ID NO: 8097 - protein, 116 aa, Artificial Sequence
  Description of Artificial Sequence: Synthetic polypeptide
QVQLQQSGAELVRPGTSVKVSCKASGYAFTNYLIEWVKQRPGQGLEWIGVINPGSGGTNYNEKFKGKATLTADKSSSTAYMQLSSLTSDDSAVYFCARDGPWFAYWGQGTLVTVSA

SEQ ID NO: 8098 - protein, 116 aa, Artificial Sequence
  Description of Artificial Sequence: Synthetic polypeptide
QIQLVQSGPELKKPGETVKISCKASGYTFTNYGMNWVRQAPGKGLKWMGWINTYTGEPTYADDFKGRFVFSLETSASTAFLQLNNLRSEDTATYFCVRFISKGDYWGQGTSVTVSS

SEQ ID NO: 8099 - protein, 114 aa, Artificial Sequence
  Description of Artificial Sequence: Synthetic polypeptide
VQLQQSDAELVKPGASVKISCKASGYTFTDHAIHWVKQNPEQGLEWIGYFSPGNDDFKYNERFKGKATLTADKSSSTAYVQLNSLTSEDSAVYFCTRSLNMAYWGQGTSVTVSS

SEQ ID NO: 8100 - protein, 116 aa, Artificial Sequence
  Description of Artificial Sequence: Synthetic polypeptide
EVQLVQSGPEVKKPGASVKVSCKASGYTFTNYGMNWVRQAPGQGLEWMGWINTYTGEPTYGEDFKGRFAFSLDTSASTAYMELSSLRSEDTAVYFCARFGNYVDYWGQGSLVTVSS

SEQ ID NO: 8101 - protein, 116 aa, Artificial Sequence
  Description of Artificial Sequence: Synthetic polypeptide
EVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSS

SEQ ID NO: 8102 - protein, 128 aa, Artificial Sequence
  Description of Artificial Sequence: Synthetic polypeptide
EVQLLESGGGLVQPGGSLRLSCAASGFTFSHYMMAWVRQAPGKGLEWVSRIGPSGGPTHYADSVKGRFTISRDNSKNTLYLQMNSLRAEDTAVYYCAGYDSGYDYVAVAGPAEYFQHWGQGTLVTVSS

SEQ ID NO: 8103 - protein, 119 aa, Artificial Sequence
  Description of Artificial Sequence: Synthetic polypeptide
EVQLVESGGGVVQPGRSLRLSCSASGFTFSGYGLSWVRQAPGKGLEWVAMISSGGSYTYYADSVKGRFAISRDNAKNTLFLQMDSLRPEDTGVYFCARHGDDPAWFAYWGQGTPVTVSS

SEQ ID NO: 8104 - protein, 118 aa, Artificial Sequence
  Description of Artificial Sequence: Synthetic polypeptide
QVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSS

SEQ ID NO: 8105 - protein, 118 aa, Artificial Sequence; identical to SEQ ID NO: 8104
  Description of Artificial Sequence: Synthetic polypeptide

SEQ ID NO: 8106 - protein, 109 aa, Artificial Sequence
  Description of Artificial Sequence: Synthetic polypeptide
GPELVKPGASVKISCKASDYSFTGYFMNWVMQSHGKSLEWIGRIFPYNGDTFYNQKFKGRATLTVDKSSSTAHMELRSLASEDSAVYFCARGTHYFDYWGQGTTLTVSS

SEQ ID NO: 8107 - protein, 115 aa, Artificial Sequence
  Description of Artificial Sequence: Synthetic polypeptide
QVQLVQSGAEVKKPGASVKVSCKASGYTFTDYEMHWVRQAPGQGLEWMGALDPKTGDTAYSQKFKGRVTLTADKSTSTAYMELSSLTSEDTAVYYCTRFYSYTYWGQGTLVTVSS

SEQ ID NO: 8108 - protein, 117 aa, Artificial Sequence
  Description of Artificial Sequence: Synthetic polypeptide
EVQLVQSGAEVKKPGESLKISCKGSGYSFTSYWIAWVRQMPGKGLEWMGIIFPGDSDTRYSPSFQGQVTISADRSIRTAYLQWSSLKASDTALYYCARTREGYFDYWGQGTLVTVSS

SEQ ID NO: 8109 - protein, 117 aa, Artificial Sequence
  Description of Artificial Sequence: Synthetic polypeptide
EVQLVQSGAEVKKPGESLKISCKGSGYSFTNYWIAWVRQMPGKGLEWMGIIYPGDSDTRYSPSFQGQVTISADKSIRTAYLQWSSLKASDTAMYYCARTREGYFDYWGQGTLVTVSS

SEQ ID NO: 8110 - protein, 117 aa, Artificial Sequence
  Description of Artificial Sequence: Synthetic polypeptide
EVQLVQSGADVTKPGESLKISCKVSGYRFTNYWIGWMRQMSGKGLEWMGIIYPGDSDTRYSPSFQGHVTISADKSINTAYLRWSSLKASDTAIYYCARTREGFFDYWGQGTPVTVSS

SEQ ID NO: 8111 - protein, 124 aa, Artificial Sequence
  Description of Artificial Sequence: Synthetic polypeptide
QVQLVESGGGVVQSGRSLRLSCAASGFTFRNYGMHWVRQAPGKGLEWVAVIWYDGSDKYYADSVRGRFTISRDNSKNTLYLQMNSLRAEDTAVYYCARDGYDILTGNPRDFDYWGQGTLVTVSS

SEQ ID NO: 8112 - protein, 119 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 8113 - protein, 120 aa, Artificial Sequence [sequence omitted]

SEQ ID NO: 8114 - protein, 125 aa, Artificial Sequence [sequence omitted]

SEQ ID NO: 8115 - protein, 121 aa, Artificial Sequence [sequence omitted]

SEQ ID NO: 8116 - protein, 121 aa, Artificial Sequence
  Description of Artificial Sequence: Synthetic polypeptide
QVQLVQSGAEVKKPGSSVKVSCKASGGTFSSYAISWVRQAPGQGLEWMGSIIPIFGTVNYAQKFQGRVTITADESTSTAYMELSSLRSEDTAVYYCARDPSVNLYWYFDLWGRGTLVTVSS

SEQ ID NO: 8117 - protein, 119 aa, Artificial Sequence
  Description of Artificial Sequence: Synthetic polypeptide
QVQLVQSGAEVKKPGSSVKVSCKASGGTFGSYAISWVRQAPGQGLEWMGSIIPIFGAANPAQKSQGRVTITADESTSTAYMELSSLRSEDTAVYYCAKMGRGKVAFDIWGQGTMVTVSS

SEQ ID NO: 8118 - protein, 123 aa, Artificial Sequence
  Description of Artificial Sequence: Synthetic polypeptide
QVQLVQSGAEVKKPGASVKVSCKASGYAFTSYGINWVRQAPGQGLEWMGWISAYNGNTYYAQKLRGRVTMTTDTSTSTAYMELRSLRSDDTAVYYCARDLGGYGSGSVPFDPWGQGTLVTVSS

SEQ ID NO: 8119 - protein, 123 aa, Artificial Sequence [sequence omitted]

SEQ ID NO: 8120 - protein, 119 aa, Artificial Sequence [sequence omitted]

SEQ ID NO: 8121 - protein, 118 aa, Artificial Sequence
  Description of Artificial Sequence: Synthetic polypeptide
QIQLVQSGPELKKPGETVKISCKASGYTFTEYPIHWVKQAPGKGFKWMGMIYTDIGKPTYAEEFKGRFAFSLETSASTAYLQINNLKNEDTATYFCVRDRYDSLFDYWGQGTTLTVSS

SEQ ID NO: 8122 - protein, 121 aa, Artificial Sequence
  Description of Artificial Sequence: Synthetic polypeptide
EMQLVESGGGFVKPGGSLKLSCAASGFAFSHYDMSWVRQTPKQRLEWVAYIASGGDITYYADTVKGRFTISRDNAQNTLYLQMSSLKSEDTAMFYCSRSSYGNNGDALDFWGQGTSVTVSS

SEQ ID NO: 8123 - protein, 119 aa, Artificial Sequence
  Description of Artificial Sequence: Synthetic polypeptide
QVQLVESGGGLVQPGGSLRLSCAASGFTFSSYAMGWVRQAPGKGLEWVSSISGSSRYIYYADSVKGRFTISRDNSKNTLYLQMNSLRAEDTAVYYCAKMDASGSYFNFWGQGTLVTVSS

SEQ ID NO: 8124 - protein, 115 aa, Artificial Sequence
  Description of Artificial Sequence: Synthetic polypeptide
QVQLLQSAAEVKKPGESLKISCKGSGYSFTSYWIGWVRQMPGKGLEWMGIIYPGDSDTRYSPSFQGQVTISADKSISTAYLQWSSLKASDTAVYYCARWRDSPLWGQGTLVTVSS

SEQ ID NO: 8125 - protein, 120 aa, Artificial Sequence [sequence omitted]

SEQ ID NO: 8126 - protein, 120 aa, Artificial Sequence
  Description of Artificial Sequence: Synthetic polypeptide
QVQLQQSGPELVKPGASLKLSCTASGFNIKDTYIHWVKQRPEQGLEWIGRIYPTNGYTRYDPKFQDKATITADTSSNTAYLQVSRLTSEDTAVYYCSRWGGDGFYAMDYWGQGASVTVSS

SEQ ID NO: 8127 - protein, 119 aa, Artificial Sequence
  Description of Artificial Sequence: Synthetic polypeptide
QVQLVESGGGLVQPGGSLRLSCAASGFTFRSYAMSWVRQAPGKGLEWVSAISGRGDNTYYADSVKGRFTISRDNSKNTLYLQMNSLRAEDTAVYYCAKMTSNAFAFDYWGQGTLVTVSS

SEQ ID NO: 8128 - protein, 119 aa, Artificial Sequence [sequence omitted]

SEQ ID NO: 8129 - protein, 119 aa, Artificial Sequence [sequence omitted]

SEQ ID NO: 8130 - protein, 121 aa, Artificial Sequence [sequence omitted]

SEQ ID NO: 8131 - protein, 118 aa, Artificial Sequence
  Description of Artificial Sequence: Synthetic polypeptide
QVQLQESGGGLVKPGGSLRLSCAASGFTFSSYWMSWVRQAPGKGLEWVANINRDGSASYYVDSVKGRFTISRDDAKNSLYLQMNSLRAEDTAVYYCARDRGVGYFDLWGRGTLVTVSS

SEQ ID NO: 8132 - protein, 129 aa, Artificial Sequence
  Description of Artificial Sequence: Synthetic polypeptide
QVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCTDRTCAKWPEWLGVWGQGTLVTVSS

SEQ ID NO: 8133 - protein, 119 aa, Artificial Sequence
  Description of Artificial Sequence: Synthetic polypeptide
EVQLVESGGGVVQPGRSLRLSCSTSGFTFSDYYMYWVRQAPGKGLEWVAYMSNVGAITDYPDTVKGRFTISRDNSKNTLFLQMDSLRPEDTGVYFCARGTRDGSWFAYWGQGTPVTVSS

SEQ ID NO: 8134 - protein, 120 aa, Artificial Sequence
  Description of Artificial Sequence: Synthetic polypeptide
QVELVQSGAEVKKPGESLKISCKGSGYSFTSYWIGWVRQAPGKGLEWMGIIDPGDSRTRYSPSFQGQVTISADKSISTAYLQWSSLKASDTAMYYCARGQLYGGTYMDGWGQGTLVTVSS

SEQ ID NO: 8135 - protein, 119 aa, Artificial Sequence
  Description of Artificial Sequence: Synthetic polypeptide
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSS

SEQ ID NO: 8136 - protein, 122 aa, Artificial Sequence
  Description of Artificial Sequence: Synthetic polypeptide
QVYLVESGGGVVQPGRSLRLSCAASGITFSIYGMHWVRQAPGKGLEWVAVIWYDGSHEYYADSVKGRFTISRDNSKNTLYLLMNSLRAEDTAVYYCARDGDYYDSGSPLDYWGQGTLVTVSS

SEQ ID NO: 8137 - protein, 122 aa, Artificial Sequence
  Description of Artificial Sequence: Synthetic polypeptide
QVHLVESGGGVVQPGRSLRLSCVASGITFRIYGMHWVRQAPGKGLEWVAVLWYDGSHEYYADSVKGRFTISRDNSKNTLYLQMNSLRAEDTAIYYCARDGDYYDSGSPLDYWGQGTLVTVSS

SEQ ID NO: 8138 - protein, 131 aa, Artificial Sequence
  Description of Artificial Sequence: Synthetic polypeptide
EVHLVESGGGLVQPGGSLRLSCAASGFTFSRYWMSWVRQAQGKGLEWVASIKQAGSEKTYVDSVKGRFTISRDNAKNSLSLQMNSLRAEDTAVYYCAREGAYYYDSASYYPYYYYYSMDVWGQGTTVTVSS

SEQ ID NO: 8139 - protein, 119 aa, Artificial Sequence
  Description of Artificial Sequence: Synthetic polypeptide
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGSGTPVTVSS

SEQ ID NO: 8140 - protein, 119 aa, Artificial Sequence
  Description of Artificial Sequence: Synthetic polypeptide
EVQLQESGPELVKPGASVKMSCKASGYTFPSYVLHWVKQKPGQGLEWIGYINPYNDGTQYNEKFKGKATLTSDKSSSTAYMELSRLTSEDSAVYYCARGFGGSYGFAYWGQGTLITVSA

SEQ ID NO: 8141 - protein, 119 aa, Artificial Sequence
  Description of Artificial Sequence: Synthetic polypeptide
QVQLQQSGAEVKKFGASVKVSCEASGYTFPSYVLHWVKQAPGQGLEWIGYINPYNDGTQTNKKFKGKATLTRDTSINTAYMELSRLRSDDTAVYYCARGFGGSYGFAYNGQGTLVTVSS

SEQ ID NO: 8142 - protein, 117 aa, Artificial Sequence
  Description of Artificial Sequence: Synthetic polypeptide
QAQLQVSGAEVVKPGASVKMSCKASGYTFTSYNMHWVKQTPGQGLEWIGYIYPGNGATNYNQKFQGKATLTADTSSSTAYMQISSLTSEDSAVYFCARGDSVPFAYWGQGTLVTVSA

SEQ ID NO: 8143 - protein, 118 aa, Artificial Sequence
  Description of Artificial Sequence: Synthetic polypeptide
QVQLQQSGAELMKPGASVKISCKATGYTFSAYWIEWVKQRPGHGLEWIGEILPGSNNSRYNEKFKGKATFTADTSSNTAYMQLSSLTSEDSAVYYCSRSYDFAWFAYWGQGTPVTVSA

SEQ ID NO: 8144 - protein, 118 aa, Artificial Sequence
  Description of Artificial Sequence: Synthetic polypeptide
QVQLVQSGAEVKKPGASVKVSCKASGYTFSAYWIEWVRQAPGKGLEWVGEILPGSNNSRYNEKFKGRVTVTRDTSTNTAYMELSSLRSEDTAVYYCARSYDFAWFAYWGQGTLVTVSS

SEQ ID NO: 8145 - protein, 123 aa, Artificial Sequence
  Description of Artificial Sequence: Synthetic polypeptide
QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS

SEQ ID NO: 8146 - protein, 121 aa, Artificial Sequence
  Description of Artificial Sequence: Synthetic polypeptide
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS

SEQ ID NO: 8147 - protein, 118 aa, Artificial Sequence [sequence omitted]

SEQ ID NO: 8148 - protein, 120 aa, Artificial Sequence
  Description of Artificial Sequence: Synthetic polypeptide
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSS

SEQ ID NO: 8149 - protein, 115 aa, Artificial Sequence
  Description of Artificial Sequence: Synthetic polypeptide
EVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSS

SEQ ID NO: 8150 - protein, 121 aa, Artificial Sequence
  Description of Artificial Sequence: Synthetic polypeptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSS

SEQ ID NO: 8151 - protein, 121 aa, Artificial Sequence
  Description of Artificial Sequence: Synthetic polypeptide
QEQLVESGGRLVTPGGSLTLSCKASGFDFSAYYMSWVRQAPGKGLEWIATIYPSSGKTYYATWVNGRFTISSDNAQNTVDLQMNSLTAADRATYFCARDSYADDGALFNIWGPGTLVTISS

SEQ ID NO: 8152 - protein, 119 aa, Artificial Sequence
  Description of Artificial Sequence: Synthetic polypeptide
EVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSS

SEQ ID NO: 8153 - protein, 117 aa, Artificial Sequence
  Description of Artificial Sequence: Synthetic polypeptide
QSLEESGGRLVTPGTPLTLTCTVSGIDLNSHWMSWVRQAPGKGLEWIGIIAASGSTYYANWAKGRFTISKTSTTVDLRIASPTTEDTATYFCARDYGDYRLVTFNIWGPGTLVTVSS

SEQ ID NO: 8154 - protein, 116 aa, Artificial Sequence
  Description of Artificial Sequence: Synthetic polypeptide
QSVKESEGDLVTPAGNLTLTCTASGSDINDYPISWVRQAPGKGLEWIGFINSGGSTWYASWVKGRFTISRTSTTVDLKMTSLTTDDTATYFCARGYSTYYCDFNIWGPGTLVTISS

SEQ ID NO: 8155 - protein, 115 aa, Artificial Sequence
  Description of Artificial Sequence: Synthetic polypeptide
QVQLVQSGAEVVKPGASVKISCKASGYTFTDHAIHWVKQNPGQRLEWIGYFSPGNDDFKYNERFKGKATLTADTSASTAYVELSSLRSEDTAVYFCTRSLNMAYWGQGTLVTVSS

SEQ ID NO: 8156 - protein, 119 aa, Artificial Sequence
  Description of Artificial Sequence: Synthetic polypeptide
  MOD_RES (68)..(68): Any amino acid
QIQLVQSGPELKKPGETVKISCKASGYTFTNFGMNWVKQGPGEGLKWMGWINTNTGEPRYAEEFKGRXAFSLETTASTAYLQINNLKNEDTATYFCARDWDGAYFFDYWGQGTTLTVSS

SEQ ID NO: 8157 - protein, 117 aa, Artificial Sequence
  Description of Artificial Sequence: Synthetic polypeptide
QVQLQQSRPELVKPGASVKMSCKASGYTFTDYVISWVKQRTGQGLEWIGEIYPGSNSIYYNEKFKGRATLTADKSSSTAYMQLSSLTSEDSAVYFCAMGGNYGFDYWGQGTTLTVSS

SEQ ID NO: 8158 - protein, 122 aa, Artificial Sequence
  Description of Artificial Sequence: Synthetic polypeptide
  MOD_RES (97)..(97): Any amino acid
EVQLVESGGGLVQPKGSLKLSCAASGFTFNTYAMNWVRQAPGKGLEWVARIRSKSNNYATYYADSVKDRFTISRDDSQSMLYLQMNNLKTEDTAMYXCVRQWDYDVRAMNYWGQGTSVTVSS

SEQ ID NO: 8159 - protein, 121 aa, Artificial Sequence
  Description of Artificial Sequence: Synthetic polypeptide
QVQLQQSGSELKKPGASVKVSCKASGYTFTNYGMNWVKQAPGQGLKWMGWINTYTGEPTYTDDFKGRFAFSLDTSVSTAYLQISSLKADDTAVYFCARGGFGSSYWYFDVWGQGSLVTVSS

SEQ ID NO: 8160 - protein, 126 aa, Artificial Sequence
  Description of Artificial Sequence: Synthetic polypeptide
QAQVVESGGGVVQSGRSLRLSCAASGFAFSSYGMHWVRQAPGKGLEWVAVIWYDGSNKYYADSVRGRFTISRDNSENTLYLQMNSLRAEDTAVYYCARDHYGSGVHHYFYYGLDVWGQGTTVTVSS

SEQ ID NO: 8161 - protein, 117 aa, Artificial Sequence
  Description of Artificial Sequence: Synthetic polypeptide
EVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVTDAFDIWGQGTMVTVSSA

SEQ ID NO: 8162 - protein, 117 aa, Artificial Sequence
  Description of Artificial Sequence: Synthetic polypeptide
EVQLVESGGGLVQPGGSLRLSCAASGFTFSSYGMSWVRQAPGKGLEWVATITSGGSYTYYVDSVKGRFTISRDNAKNTLYLQMNSLRAEDTAVYYCVRIGEDALDYWGQGTLVTVSS

SEQ ID NO: 8163 - protein, 118 aa, Artificial Sequence
  Description of Artificial Sequence: Synthetic polypeptide
KVQLQQSGTELVKPGASVKVSCKASGYIFTEYIIHWVKQRSGQGLEWIGWLYPESNIIKYNEKFKDKATLTADKSSSTVYMELSRLTSEDSAVYFCTRHDGTNFDYWGQGTTLTVSSA

SEQ ID NO: 8164 - protein, 106 aa, Artificial Sequence [sequence omitted]

SEQ ID NO: 8165 - protein, 107 aa, Artificial Sequence
  Description of Artificial Sequence: Synthetic polypeptide
EIVLTQSPGTLSLSPGERATLSCRASQSVSSTYLAWYQQKPGQAPRLLIYGASSRATGIPDRFSGSGSGTDFTLTISRLEPEDFAVYYCQHYDNSQTFGQGTKVEIK

SEQ ID NO: 8166 - protein, 106 aa, Artificial Sequence
  Description of Artificial Sequence: Synthetic polypeptide
ENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIK

SEQ ID NO: 8167 - protein, 111 aa, Artificial Sequence
  Description of Artificial Sequence: Synthetic polypeptide
DIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIK

SEQ ID NO: 8168 - protein, 106 aa, Artificial Sequence
  Description of Artificial Sequence: Synthetic polypeptide
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIK

SEQ ID NO: 8169 - protein, 107 aa, Artificial Sequence
  Description of Artificial Sequence: Synthetic polypeptide
QTVLSQSPAILSASPGEKVTMTCRASSSVTYIHWYQQKPGSSPKSWIYATSNLASGVPARFSGSGSGTSYSLTISRVEAEDAATYYCQHWSSKPPTFGGGTKLEIKR

SEQ ID NO: 8170 - protein, 116 aa, Artificial Sequence
  Description of Artificial Sequence: Synthetic polypeptide
QAVLTQPASLSASPGASASLTCTLRRGINVGAYSIYWYQQKPGSPPQYLLRYKSDSDKQQGSGVSSRFSASKDASANAGILLISGLQSEDEADYYCMIWHSGASAVFGGGTKLTVL

SEQ ID NO: 8171 - protein, 111 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 8172 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIK

SEQ ID NO: 8173 - protein, 106 aa, Artificial Sequence [sequence omitted]

SEQ ID NO: 8174 - protein, 112 aa, Artificial Sequence
  Description of Artificial Sequence: Synthetic polypeptide
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIK

SEQ ID NO: 8175 - protein, 106 aa, Artificial Sequence [sequence omitted]

SEQ ID NO: 8176 - protein, 106 aa, Artificial Sequence [sequence omitted]

SEQ ID NO: 8177 - protein, 111 aa, Artificial Sequence [sequence omitted]

SEQ ID NO: 8178 - protein, 107 aa, Artificial Sequence [sequence omitted]

SEQ ID NO: 8179 - protein, 111 aa, Artificial Sequence
  Description of Artificial Sequence: Synthetic polypeptide
DIVLTQSPASLAVSLGQRATISCRASKSVSTSGYSFMHWYQQKPGQPPKLLIYLASNLESGVPARFSGSGSGTDFTLNIHPVEEEDAATYYCQHSREVPWTFGGGTKLEIK

SEQ ID NO: 8180 - protein, 111 aa, Artificial Sequence
  Description of Artificial Sequence: Synthetic polypeptide
DIVLTQSPASLTVSLGQKTTISCRASKSVSTSGYSFMHWYQLKPGQSPKLLIYLASDLPSGVPARFSGSGSGTDFTLKIHPVEEEDAATYYCQHSREIPYTFGGGTKLEIT

SEQ ID NO: 8181 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRTNWPLTFGGGTKVEIK

SEQ ID NO: 8182 - protein, 107 aa, Artificial Sequence
  Description of Artificial Sequence: Synthetic polypeptide
AIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIK

SEQ ID NO: 8183 - protein, 107 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK

SEQ ID NO: 8184 - protein, 107 aa, Artificial Sequence
  Description of Artificial Sequence: Synthetic polypeptide
EIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIK

SEQ ID NO: 8185 - protein, 107 aa, Artificial Sequence
  Description of Artificial Sequence: Synthetic polypeptide
DIQMTQSPSSVSASVGDRVTITCRASQGINTWLAWYQQKPGKAPKLLIYAASSLKSGVPSRFSGSGSGTDFTLTISSLQPEDFATYYCQQANSFPLTFGGGTKVEIK

SEQ ID NO: 8186 - protein, 108 aa, Artificial Sequence [sequence omitted]

SEQ ID NO: 8187 - protein, 113 aa, Artificial Sequence [sequence omitted]

SEQ ID NO: 8188 - protein, 107 aa, Artificial Sequence
  Description of Artificial Sequence: Synthetic polypeptide
DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIK

SEQ ID NO: 8189 - protein, 108 aa, Artificial Sequence
  Description of Artificial Sequence: Synthetic polypeptide
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 8190 - protein, 107 aa, Artificial Sequence
  Description of Artificial Sequence: Synthetic polypeptide
EIVLTQSPDFQSVTPKEKVTITCRASQSIGISLHWYQQKPDQSPKLLIKYASQSFSGVPSRFSGSGSGTDFTLTINSLEAEDAATYYCHQSRSFPWTFGQGTKVEIK

SEQ ID NO: 8191 - protein, 113 aa, Artificial Sequence
  Description of Artificial Sequence: Synthetic polypeptide
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIK

SEQ ID NO: 8192 - protein, 107 aa, Artificial Sequence
  Description of Artificial Sequence: Synthetic polypeptide
ELQMTQSPSSLSASVGDRVTITCRTSQSISSYLNWYQQKPGQPPKLLIYWASTRESGVPDRFSGSGSGTDFTLTISSLQPEDSATYYCQQSYDIPYTFGQGTKLEIK

SEQ ID NO: 8193 - protein, 107 aa, Artificial Sequence
  Description of Artificial Sequence: Synthetic polypeptide
NIVMTQSPKSMSMSVGERVTLTCKASENVVTYVSWYQQKPEQSPKLLIYGASNRYTGVPDRFTGSGSATDFTLTISSVQAEDLADYHCGQGYSYPYTFGGGTKLEIK

SEQ ID NO: 8194 - protein, 106 aa, Artificial Sequence
  Description of Artificial Sequence: Synthetic polypeptide
QILLTQSPAIMSASPGEKVTMTCSASSSVSYMLWYQQKPGSSPKPWIFDTSNLASGFPARFSGSGSGTSYSLIISSMEAEDAATYYCHQRSGYPYTFGGGTKLEIK

SEQ ID NO: 8195 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSYPLTFGGGTKVKES

SEQ ID NO: 8196 - protein, 112 aa, Artificial Sequence
  Description of Artificial Sequence: Synthetic polypeptide
DIVMTQSPLSLPVTPGEPASISCRSSINKKGSNGITYLYWYLQKPGQSPQLLIYQMSNLASGVPDRFSGSGSGTDFTLKISRVEAEDVGVYYCAQNLEIPRTFGQGTKVEIK

SEQ ID NO: 8197 - protein, 112 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIK

SEQ ID NO: 8198 - protein, 112 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVELK

SEQ ID NO: 8199 - protein, 107 aa, Artificial Sequence
  Description of Artificial Sequence: Synthetic polypeptide
DIQMTQSPSSLSASVGDRVTITCRASQSISTWLAWYQQKPGKAPKLLIYKASNLHTGVPSRFSGSGSGTEFSLTISGLQPDDFATYYCQQYNSYSRTFGQGTKVEIK

SEQ ID NO: 8200 - protein, 110 aa, Artificial Sequence
  Description of Artificial Sequence: Synthetic polypeptide
DIQLTQSPSSLSASVGDRVTITCSVSSSISSNNLHWYQQKPGKAPKPWIYGTSNLASGVPSRFSGSGSGTDYTFTISSLQPEDIATYYCQQWSSYPYMYTFGQGTKVEIK

SEQ ID NO: 8201 - protein, 111 aa, Artificial Sequence
  Description of Artificial Sequence: Synthetic polypeptide
DIVLTQSPLSLAVSLGQPAIISCKASQSVSFAGTSLMHWYHQKPGQQPRLLIYRASNLEAGVPDRFSGSGSKTDFTLNISPVEAEDAATYYCQQSREYPYTFGGGTKLEIK

SEQ ID NO: 8202 - protein, 111 aa, Artificial Sequence
  Description of Artificial Sequence: Synthetic polypeptide
DIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIK

SEQ ID NO: 8203 - protein, 100 aa, Artificial Sequence
  Description of Artificial Sequence: Synthetic polypeptide
PASLSASVGETVTITCRTSENIFSYLAWYQQKQGISPQLLVYNAKTLAEGVPSRFSGSGSGTQFSLKINSLQPEDFGSYYCQHHYAFPWTFGGGSKLEIK

SEQ ID NO: 8204 - protein, 112 aa, Artificial Sequence
  Description of Artificial Sequence: Synthetic polypeptide
DVVMTQSPLSLPVTPGEPASISCRSSQSLVHSNGNTYLHWYLQKPGQSPQLLIYKVSNRFSGVPDRFSGSGSGTDFTLKISRVEAEDVGVYYCSQNTHVPPTFGQGTKLEIK

SEQ ID NO: 8205 - protein, 107 aa, Artificial Sequence
  Description of Artificial Sequence: Synthetic polypeptide
EIVLTQSPGTLSLSPGERATLSCRAVQSVSSSYLAWYQQKPGQAPRLLIYGASSRATGIPDRFSGSGSGTDFTLTISRLEPEDFAVYYCQQYGSSPTFGGGTKVEIK

SEQ ID NO: 8206 - protein, 107 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIK

SEQ ID NO: 8207 - protein, 107 aa, Artificial Sequence
  Description of Artificial Sequence: Synthetic polypeptide
EILLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTKVEIK

SEQ ID NO: 8208 - protein, 112 aa, Artificial Sequence
  Description of Artificial Sequence: Synthetic polypeptide
DTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGQGTKVEIK

SEQ ID NO: 8209 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 8210 - protein, 106 aa, Artificial Sequence [sequence omitted]

SEQ ID NO: 8211 - protein, 107 aa, Artificial Sequence [sequence omitted]

SEQ ID NO: 8212 - protein, 107 aa, Artificial Sequence [sequence omitted]

SEQ ID NO: 8213 - protein, 107 aa, Artificial Sequence
  Description of Artificial Sequence: Synthetic polypeptide
DIQMTQSPSTLSASVGDRVTITCRASQSISSWWAWYQQKPGKAPKLLIYDASSLESGVPSRFSGSGSGTEFTLTISSLQPDDFATYYCQQYHAHPTTFGGGTKVEIK

SEQ ID NO: 8214 - protein, 113 aa, Artificial Sequence
  Description of Artificial Sequence: Synthetic polypeptide
DIVMTQSPDSLAVSLGERATINCKSSQSVLYSPNNKNYLAWYQQKPGQPPKLLIYWASTRESGVPDRFSGSGSGTDFTLTISSLQAEDVAVYYCQQYYGSPITFGGGTKVEIK

SEQ ID NO: 8215 - protein, 108 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQDYRTWPRRVFGGGTKVEIK

SEQ ID NO: 8216 - protein, 112 aa, Artificial Sequence [sequence omitted]

SEQ ID NO: 8217 - protein, 107 aa, Artificial Sequence [sequence omitted]

SEQ ID NO: 8218 - protein, 112 aa, Artificial Sequence
  Description of Artificial Sequence: Synthetic polypeptide
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIK

SEQ ID NO: 8219 - protein, 111 aa, Artificial Sequence
  Description of Artificial Sequence: Synthetic polypeptide
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVLTFGSGTKLEIK

SEQ ID NO: 8220 - protein, 102 aa, Artificial Sequence
  Description of Artificial Sequence: Synthetic polypeptide
QSPSFLSAFVGDRITITCRASPGIRNYLAWYQQKPGKAPKLLIYAASTLQSGVPSRFSGSGSGTDFTLTISSLQPEDFATYYCQQYNSYPLSFGGGTKVEIK

SEQ ID NO: 8221 - protein, 110 aa, Artificial Sequence
  Description of Artificial Sequence: Synthetic polypeptide
QAVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGQYVFGGGTKLTVL

SEQ ID NO: 8222 - protein, 107 aa, Artificial Sequence [sequence omitted]

SEQ ID NO: 8223 - protein, 107 aa, Artificial Sequence
  Description of Artificial Sequence: Synthetic polypeptide
DIVMTQSHKFMSTSVGDRVSITCKASQDVNTAVAWYQQKPGHSPKLLIYSASFRYTGVPDRFTGSRSGTDFTFTISSVQAEDLAVYYCQQHYTTPPTFGGGTKVEIK

SEQ ID NO: 8224 - protein, 111 aa, Artificial Sequence
  Description of Artificial Sequence: Synthetic polypeptide
QSVLTQPPSVSGAPGQRVTISCTGSSSNIGAGYGVHWYQQLPGTAPKLLIYGNTNRPSGVPDRFSGFKSGTSASLAITGLQAEDEADYYCQFYDSSLSGWVFGGGTKLTVL

SEQ ID NO: 8225 - protein, 107 aa, Artificial Sequence [sequence omitted]

SEQ ID NO: 8226 - protein, 111 aa, Artificial Sequence [sequence omitted]

SEQ ID NO: 8227 - protein, 107 aa, Artificial Sequence [sequence omitted]

SEQ ID NO: 8228 - protein, 111 aa, Artificial Sequence
  Description of Artificial Sequence: Synthetic polypeptide
QSALTQPASVSGSPGQSITISCTGTSSDVGGYNFVSWYQQHPGKAPKLMIYDVSDRPSGVSDRFSGSKSGNTASLIISGLQADDEADYYCSSYGSSSTHVIFGGGTKVTVL

SEQ ID NO: 8229 - protein, 110 aa, Artificial Sequence
  Description of Artificial Sequence: Synthetic polypeptide
QSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKLTVL

SEQ ID NO: 8230 - protein, 112 aa, Artificial Sequence
  Description of Artificial Sequence: Synthetic polypeptide
DIQMTQSPSSLSASVGDRVTITCRSSQRIVHSNGNTYLEWYQQTPGKAPKLLIYKVSNRFSGVPSRFSGSGSGTDFTFTISSLQPEDIATYYCFQGSHVPFTFGQGTKLQIT

SEQ ID NO: 8231 - protein, 111 aa, Artificial Sequence
  Description of Artificial Sequence: Synthetic polypeptide
DIALTQPASVSGSPGQSITISCTGTSSDIGGYNSVSWYQQHPGKAPKLMIYGVNNRPSGVSNRFSGSKSGNTASLTISGLQAEDEADYYCSSYDIESATPVFGGGTKLTVL

SEQ ID NO: 8232 - protein, 106 aa, Artificial Sequence
  Description of Artificial Sequence: Synthetic polypeptide
DIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEIK

SEQ ID NO: 8233 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK

SEQ ID NO: 8234 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSQYTFGQGTKLEIK

SEQ ID NO: 8235 - protein, 106 aa, Artificial Sequence
  Description of Artificial Sequence: Synthetic polypeptide
DIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGSGTKVEIK

SEQ ID NO: 8236 - protein, 108 aa, Artificial Sequence
  Description of Artificial Sequence: Synthetic polypeptide
DIVMTQSPAIMSASPGEKVTMTCSASSSVSSSYLYWYQQKPGSSPKLWIYSTSNLASGVPARFSGSGSGTSYSLTISSMEAEDAASYFCHQWNRYPYTFGGGTKLEIK

SEQ ID NO: 8237 - protein, 108 aa, Artificial Sequence
  Description of Artificial Sequence: Synthetic polypeptide
DIQLTQSPSSLSASVGDRVTMTCSASSSVSSSYLYWYQQKPGKAPKLWIYSTSNLASGVPARFSGSGSGTDFTLTISSLQPEDSASYFCHQWNRYPYTFGGGTRLEIK

SEQ ID NO: 8238 - protein, 106 aa, Artificial Sequence
  Description of Artificial Sequence: Synthetic polypeptide
EIVLTQSPATMSASPGERVTITCSAHSSVSFMHWFQQKPGTSPKLWIYSTSSLASGVPARFGGSGSGTSYSLTISSMEAEDAATYYCQQRSSFPLTFGAGTKLELK

SEQ ID NO: 8239 - protein, 113 aa, Artificial Sequence
  Description of Artificial Sequence: Synthetic polypeptide
DIVMSQSPSSLAVSVGEKVTMSCKSSQSLLYSSNQKIYLAWYQQKPGQSPKLLIYWASTRESGVPDRFTGGGSGTDFTLTISSVKAEDLAVYYCQQYYRYPRTFGGGTKLEIK

SEQ ID NO: 8240 - protein, 113 aa, Artificial Sequence
  Description of Artificial Sequence: Synthetic polypeptide
DIQMTQSPSSLSASVGDRVTITCKSSQSLLYSSNQKIYLAWYQQKPGKAPKLLIYWASTRESGVPSRFSGSGSGTDFTFTISSLQPEDIATYYCQQYYRYPRTFGQGTKVEIK

SEQ ID NO: 8241 - protein, 106 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 8242 - protein, 108 aa, Artificial Sequence
  Description of Artificial Sequence: Synthetic polypeptide
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK

SEQ ID NO: 8243 - protein, 107 aa, Artificial Sequence [sequence omitted]

SEQ ID NO: 8244 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL

SEQ ID NO: 8245 - protein, 107 aa, Artificial Sequence
  Description of Artificial Sequence: Synthetic polypeptide
DIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIK

SEQ ID NO: 8246 - protein, 107 aa, Artificial Sequence
  Description of Artificial Sequence: Synthetic polypeptide
DIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIK

SEQ ID NO: 8247 - protein, 112 aa, Artificial Sequence
  Description of Artificial Sequence: Synthetic polypeptide
ELVLTQSPSVSAALGSPAKITCTLSSAHKTDTIDWYQQLQGEAPRYLMQVQSDGSYTKRPGVPDRFSGSSSGADRYLIIPSVQADDEADYYCGADYIGGYVFGGGTQLTVTG

SEQ ID NO: 8248 - protein, 107 aa, Artificial Sequence
  Description of Artificial Sequence: Synthetic polypeptide
DIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMK

SEQ ID NO: 8249 - protein, 108 aa, Artificial Sequence
  Description of Artificial Sequence: Synthetic polypeptide
ELVMTQTPSSVSAAVGGTVTINCQASQSIGSYLAWYQQKPGQPPKLLIYYASNLASGVPSRFSGSGSGTEYTLTISGVQREDAATYYCLGSLSNSDNVFGGGTELEIL

SEQ ID NO: 8250 - protein, 110 aa, Artificial Sequence
  Description of Artificial Sequence: Synthetic polypeptide
ELVMTQTPSSTSGAVGGTVTINCQASQSIDSNLAWFQQKPGQPPTLLIYRASNLASGVPSRFSGSRSGTEYTLTISGVQREDAATYYCLGGVGNVSYRTSFGGGTEVVVK

SEQ ID NO: 8251 - protein, 113 aa, Artificial Sequence
  Description of Artificial Sequence: Synthetic polypeptide
DIVMSQSPDSLAVSLGERVTLNCKSSQSLLYSGNQKNYLAWYQQKPGQSPKLLIYWASARESGVPDRFSGSGSGTDFTLTISSVQAEDVAVYYCQQYYSYPLTFGAGTKLELK

SEQ ID NO: 8252 - protein, 107 aa, Artificial Sequence
  Description of Artificial Sequence: Synthetic polypeptide
SIVMTQTPKFLLVSAGDRVTITCKASQSVSNDVAWYQQKPGQSPKLLINFATNRYTGVPNRFTGSGYGTDFTFTISTVQAEDLALYFCQQDYSSPWTFGGGTKLEIK

SEQ ID NO: 8253 - protein, 115 aa, Artificial Sequence
  Description of Artificial Sequence: Synthetic polypeptide
SVIMSRGQIVLTQSPAIMSASLGERVTLTCTASSSVNSNYLHWYQQKPGSSPKLWIYSTSNLASGVPARFSGSGSGTSYSLTISSMEAEDAATYYCHQYHRSPLTFGAGTKLELK

SEQ ID NO: 8254 - protein, 107 aa, Artificial Sequence
  Description of Artificial Sequence: Synthetic polypeptide
DIVMTQSHIFMSTSVGDRVSITCKASQDVDTAVAWYQQKPGQSPKLLIYWASTRLTGVPDRFTGSGSGTDFTLTISNVQSEDLADYFCQQYSSYPYTFGGGTKLEIK

SEQ ID NO: 8255 - protein, 107 aa, Artificial Sequence
  Description of Artificial Sequence: Synthetic polypeptide
DIQLTQSPSSLSASVGDRVSITCKASQDVSIAVAWYQQKPGKAPKLLIYSASYRYTGVPDRFSGSGSGTDFTLTISSLQPEDFAVYYCQQHYITPLTFGAGTKVEIK

SEQ ID NO: 8256 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 8257 - protein, 107 aa, Artificial Sequence [sequence omitted]

SEQ ID NO: 8258 - protein, 107 aa, Artificial Sequence
  Description of Artificial Sequence: Synthetic polypeptide
DIQMTQSPSSLSASVGDRVTITCRASQDIAGSLNWLQQKPGKAIKRLIYATSSLDSGVPKRFSGSRSGSDYTLTISSLQPEDFATYYCLQYGSFPPTFGQGTKVEIK

SEQ ID NO: 8259 - protein, 111 aa, Artificial Sequence
  Description of Artificial Sequence: Synthetic polypeptide
DIVLTQSPASLAVSLGQRATISCRASESVDSYGNSFMHWYQQKPGQPPKLLIYRASNLESGIPARFSGSGSRTDFTLTINPVEADDVATYYCQQSNEDPLTFGAGTKLELK

SEQ ID NO: 8260 - protein, 15 aa, Artificial Sequence
  Description of Artificial Sequence: Synthetic peptide
SPAGSPTSTESGTSE

SEQ ID NO: 8261 - protein, 16 aa, Artificial Sequence
  Description of Artificial Sequence: Synthetic peptide
EAGRSANHEPLGLVAT

SEQ ID NO: 8262 - protein, 16 aa, Artificial Sequence
  Description of Artificial Sequence: Synthetic peptide
ASGRSTNAGPSGLAGP

SEQ ID NO: 8263 - protein, 16 aa, Artificial Sequence
  Description of Artificial Sequence: Synthetic peptide
ASGRSTNAGPQGLAGQ

SEQ ID NO: 8264 - protein, 16 aa, Artificial Sequence
  Description of Artificial Sequence: Synthetic peptide
ASGRSTNAGPPGLTGP

SEQ ID NO: 8265 - protein, 16 aa, Artificial Sequence
  Description of Artificial Sequence: Synthetic peptide
ASSRGTNAGPAGLTGP

SEQ ID NO: 8266 - protein, 16 aa, Artificial Sequence
  Description of Artificial Sequence: Synthetic peptide
ASSRTTNTGPSTLTGP

SEQ ID NO: 8267 - protein, 16 aa, Artificial Sequence
  Description of Artificial Sequence: Synthetic peptide
AAGRSDNGTPLELVAP

SEQ ID NO: 8268 - protein, 16 aa, Artificial Sequence
  Description of Artificial Sequence: Synthetic peptide
ASGRGTNAGPAGLTGP

SEQ ID NO: 8269 - protein, 16 aa, Artificial Sequence
  Description of Artificial Sequence: Synthetic peptide
LFGRNDNHEPLELGGG

SEQ ID NO: 8270 - protein, 16 aa, Artificial Sequence
  Description of Artificial Sequence: Synthetic peptide
TAGRSDNLEPLGLVFG

SEQ ID NO: 8271 - protein, 16 aa, Artificial Sequence
  Description of Artificial Sequence: Synthetic peptide
LDGRSDNFHPPELVAG

SEQ ID NO: 8272 - protein, 16 aa, Artificial Sequence
  Description of Artificial Sequence: Synthetic peptide
LEGRSDNEEPENLVAG

SEQ ID NO: 8273 - protein, 16 aa, Artificial Sequence
  Description of Artificial Sequence: Synthetic peptide
LKGRSDNNAPLALVAG

SEQ ID NO: 8274 - protein, 16 aa, Artificial Sequence
  Description of Artificial Sequence: Synthetic peptide
VYSRGTNAGPHGLTGR

SEQ ID NO: 8275 - protein, 16 aa, Artificial Sequence
  Description of Artificial Sequence: Synthetic peptide
ANSRGTNKGFAGLIGP

SEQ ID NO: 8276 - protein, 16 aa, Artificial Sequence
  Description of Artificial Sequence: Synthetic peptide
ASSRLTNEAPAGLTIP

SEQ ID NO: 8277 - protein, 16 aa, Artificial Sequence
  Description of Artificial Sequence: Synthetic peptide
DQSRGTNAGPEGLTDP

SEQ ID NO: 8278 - protein, 16 aa, Artificial Sequence
  Description of Artificial Sequence: Synthetic peptide
ESSRGTNIGQGGLTGP

SEQ ID NO: 8279 - protein, 16 aa, Artificial Sequence
  Description of Artificial Sequence: Synthetic peptide
SSSRGTNQDPAGLTIP

SEQ ID NO: 8280 - protein, 16 aa, Artificial Sequence
  Description of Artificial Sequence: Synthetic peptide
ASSRGQNHSPMGLTGP

SEQ ID NO: 8281 - protein, 16 aa, Artificial Sequence
  Description of Artificial Sequence: Synthetic peptide
AYSRGPNAGPAGLEGR

SEQ ID NO: 8282 - protein, 16 aa, Artificial Sequence
  Description of Artificial Sequence: Synthetic peptide
ASERGNNAGPANLTGF

SEQ ID NO: 8283 - protein, 16 aa, Artificial Sequence
  Description of Artificial Sequence: Synthetic peptide
ASHRGTNPKPAILTGP

SEQ ID NO: 8284 - protein, 16 aa, Artificial Sequence
  Description of Artificial Sequence: Synthetic peptide
MSSRRTNANPAQLTGP

SEQ ID NO: 8285 - protein, 16 aa, Artificial Sequence
  Description of Artificial Sequence: Synthetic peptide
GAGRTDNHEPLELGAA

SEQ ID NO: 8286 - protein, 16 aa, Artificial Sequence
  Description of Artificial Sequence: Synthetic peptide
LAGRSENTAPLELTAG

SEQ ID NO: 8287 - protein, 16 aa, Artificial Sequence
  Description of Artificial Sequence: Synthetic peptide
LEGRPDNHEPLALVAS

SEQ ID NO: 8288 - protein, 16 aa, Artificial Sequence
  Description of Artificial Sequence: Synthetic peptide
LSGRSDNEEPLALPAG

SEQ ID NO: 8289 - protein, 16 aa, Artificial Sequence
  Description of Artificial Sequence: Synthetic peptide
EAGRTDNHEPLELSAP

SEQ ID NO: 8290 - protein, 16 aa, Artificial Sequence
  Description of Artificial Sequence: Synthetic peptide
EGGRSDNHGPLELVSG

SEQ ID NO: 8291 - protein, 16 aa, Artificial Sequence
  Description of Artificial Sequence: Synthetic peptide
LSGRSDNEAPLELEAG

SEQ ID NO: 8292 - protein, 16 aa, Artificial Sequence
  Description of Artificial Sequence: Synthetic peptide
LGGRADNHEPPELGAG

SEQ ID NO: 8293 - protein, 16 aa, Artificial Sequence
  Description of Artificial Sequence: Synthetic peptide
PPSRGTNAEPAGLTGE

SEQ ID NO: 8294 - protein, 16 aa, Artificial Sequence
  Description of Artificial Sequence: Synthetic peptide
ASTRGENAGPAGLEAP

SEQ ID NO: 8295 - protein, 16 aa, Artificial Sequence
  Description of Artificial Sequence: Synthetic peptide
ESSRGTNGAPEGLTGP

SEQ ID NO: 8296 - protein, 16 aa, Artificial Sequence
  Description of Artificial Sequence: Synthetic peptide
ASSRATNESPAGLTGE

SEQ ID NO: 8297 - protein, 16 aa, Artificial Sequence
  Description of Artificial Sequence: Synthetic peptide
ASSRGENPPPGGLTGP

SEQ ID NO: 8298 - protein, 16 aa, Artificial Sequence
  Description of Artificial Sequence: Synthetic peptide
AASRGTNTGPAELTGS

SEQ ID NO: 8299 - protein, 16 aa, Artificial Sequence
  Description of Artificial Sequence: Synthetic peptide
AGSRTTNAGPGGLEGP

SEQ ID NO: 8300 - protein, 16 aa, Artificial Sequence
  Description of Artificial Sequence: Synthetic peptide
APSRGENAGPATLTGA

SEQ ID NO: 8301 - protein, 16 aa, Artificial Sequence
  Description of Artificial Sequence: Synthetic peptide
ESGRAANTGPPTLTAP

SEQ ID NO: 8302 - protein, 16 aa, Artificial Sequence
  Description of Artificial Sequence: Synthetic peptide
NPGRAANEGPPGLPGS

SEQ ID NO: 8303 - protein, 16 aa, Artificial Sequence
  Description of Artificial Sequence: Synthetic peptide
ESSRAANLTPPELTGP

SEQ ID NO: 8304 - protein, 16 aa, Artificial Sequence
  Description of Artificial Sequence: Synthetic peptide
ASGRAANETPPGLTGA

SEQ ID NO: 8305 - protein, 16 aa, Artificial Sequence
  Description of Artificial Sequence: Synthetic peptide
NSGRGENLGAPGLTGT

SEQ ID NO: 8306 - protein, 16 aa, Artificial Sequence
  Description of Artificial Sequence: Synthetic peptide
TTGRAANLTPAGLTGP

SEQ ID NO: 8307 - protein, 16 aa, Artificial Sequence
  Description of Artificial Sequence: Synthetic peptide
EAGRSANHTPAGLTGP

SEQ ID NO: 8308 - protein, 16 aa, Artificial Sequence
  Description of Artificial Sequence: Synthetic peptide
ESGRAANTTPAGLTGP

SEQ ID NO: 8309 - protein, 19 aa, Artificial Sequence
  Description of Artificial Sequence: Synthetic peptide
TTGRATEAANLTPAGLTGP

SEQ ID NO: 8310 - protein, 19 aa, Artificial Sequence
  Description of Artificial Sequence: Synthetic peptide
TTGRAEEAANLTPAGLTGP

SEQ ID NO: 8311 - protein, 19 aa, Artificial Sequence
  Description of Artificial Sequence: Synthetic peptide
TTGRAGEAANLTPAGLTGP

SEQ ID NO: 8312 - protein, 19 aa, Artificial Sequence
  Description of Artificial Sequence: Synthetic peptide
TTGRATEAANATPAGLTGP

SEQ ID NO: 8313 - protein, 19 aa, Artificial Sequence
  Description of Artificial Sequence: Synthetic peptide
TTGRAGEAEGATSAGATGP

SEQ ID NO: 8314 - protein, 19 aa, Artificial Sequence
  Description of Artificial Sequence: Synthetic peptide
TTGEAGEAANATSAGATGP

SEQ ID NO: 8315 - protein, 19 aa, Artificial Sequence
  Description of Artificial Sequence: Synthetic peptide
TTGEAGEAAGLTPAGLTGP

SEQ ID NO: 8316 - protein, 19 aa, Artificial Sequence
  Description of Artificial Sequence: Synthetic peptide
TTGAAGEAANATPAGLTGP

SEQ ID NO: 8317 - protein, 19 aa, Artificial Sequence
  Description of Artificial Sequence: Synthetic peptide
TTGRAGEAAGLTPAGLTGP

SEQ ID NO: 8318 - protein, 19 aa, Artificial Sequence
  Description of Artificial Sequence: Synthetic peptide
TTGRAGEAANATSAGATGP

SEQ ID NO: 8319 - protein, 19 aa, Artificial Sequence
  Description of Artificial Sequence: Synthetic peptide
TTGEAGEAAGATSAGATGP

SEQ ID NO: 8320 - protein, 16 aa, Artificial Sequence
  Description of Artificial Sequence: Synthetic peptide
ESGRAANTEPPELGAG

SEQ ID NO: 8321 - protein, 16 aa, Artificial Sequence
  Description of Artificial Sequence: Synthetic peptide
ESGRAANTAPEGLTGP

SEQ ID NO: 8322 - protein, 16 aa, Artificial Sequence
  Description of Artificial Sequence: Synthetic peptide
EPGRAANHEPSGLTEG

SEQ ID NO: 8323 - protein, 19 aa, Artificial Sequence
  Description of Artificial Sequence: Synthetic peptide
ESGRAANHTGAPPGGLTGP

SEQ ID NO: 8324 - protein, 19 aa, Artificial Sequence
  Description of Artificial Sequence: Synthetic peptide
TTGRTGEGANATPGGLTGP

SEQ ID NO: 8325 - protein, 19 aa, Artificial Sequence
  Description of Artificial Sequence: Synthetic peptide
RTGRSGEAANETPEGLEGP

SEQ ID NO: 8326 - protein, 19 aa, Artificial Sequence
  Description of Artificial Sequence: Synthetic peptide
RTGRTGESANETPAGLGGP

SEQ ID NO: 8327 - protein, 19 aa, Artificial Sequence
  Description of Artificial Sequence: Synthetic peptide
STGRTGEPANETPAGLSGP

SEQ ID NO: 8328 - protein, 19 aa, Artificial Sequence
  Description of Artificial Sequence: Synthetic peptide
TTGRAGEPANATPTGLSGP

SEQ ID NO: 8329 - protein, 19 aa, Artificial Sequence
  Description of Artificial Sequence: Synthetic peptide
RTGRPGEGANATPTGLPGP

SEQ ID NO: 8330 - protein, 19 aa, Artificial Sequence
  Description of Artificial Sequence: Synthetic peptide
RTGRGGEAANATPSGLGGP

SEQ ID NO: 8331 - protein, 19 aa, Artificial Sequence
  Description of Artificial Sequence: Synthetic peptide
STGRSGESANATPGGLGGP

SEQ ID NO: 8332 - protein, 19 aa, Artificial Sequence
  Description of Artificial Sequence: Synthetic peptide
RTGRTGEEANATPAGLPGP

SEQ ID NO: 8333 - protein, 19 aa, Artificial Sequence
  Description of Artificial Sequence: Synthetic peptide
ATGRPGEPANTTPEGLEGP

SEQ ID NO: 8334 - protein, 19 aa, Artificial Sequence
  Description of Artificial Sequence: Synthetic peptide
STGRSGEPANATPGGLTGP

SEQ ID NO: 8335 - protein, 19 aa, Artificial Sequence
  Description of Artificial Sequence: Synthetic peptide
PTGRGGEGANTTPTGLPGP

SEQ ID NO: 8336 - protein, 19 aa, Artificial Sequence
  Description of Artificial Sequence: Synthetic peptide
PTGRSGEGANATPSGLTGP

SEQ ID NO: 8337 - protein, 19 aa, Artificial Sequence
  Description of Artificial Sequence: Synthetic peptide
TTGRASEGANSTPAPLTEP

SEQ ID NO: 8338 - protein, 19 aa, Artificial Sequence
  Description of Artificial Sequence: Synthetic peptide
TYGRAAEAANTTPAGLTAP

SEQ ID NO: 8339 - protein, 19 aa, Artificial Sequence
  Description of Artificial Sequence: Synthetic peptide
TTGRATEGANATPAELTEP

SEQ ID NO: 8340 - protein, 19 aa, Artificial Sequence
  Description of Artificial Sequence: Synthetic peptide
TVGRASEEANTTPASLTGP

SEQ ID NO: 8341 - protein, 19 aa, Artificial Sequence
  Description of Artificial Sequence: Synthetic peptide
TTGRAPEAANATPAPLTGP

SEQ ID NO: 8342 - protein, 19 aa, Artificial Sequence
  Description of Artificial Sequence: Synthetic peptide
TWGRATEPANATPAPLTSP

SEQ ID NO: 8343 - protein, 19 aa, Artificial Sequence
  Description of Artificial Sequence: Synthetic peptide
TVGRASESANATPAELTSP

SEQ ID NO: 8344 - protein, 19 aa, Artificial Sequence
  Description of Artificial Sequence: Synthetic peptide
TVGRAPEGANSTPAGLTGP

SEQ ID NO: 8345 - protein, 19 aa, Artificial Sequence
  Description of Artificial Sequence: Synthetic peptide
TWGRATEAPNLEPATLTTP

SEQ ID NO: 8346 - protein, 19 aa, Artificial Sequence
  Description of Artificial Sequence: Synthetic peptide
TTGRATEAPNLTPAPLTEP

SEQ ID NO: 8347 - protein, 19 aa, Artificial Sequence
  Description of Artificial Sequence: Synthetic peptide
TQGRATEAPNLSPAALTSP

SEQ ID NO: 8348 - protein, 19 aa, Artificial Sequence
  Description of Artificial Sequence: Synthetic peptide
TQGRAAEAPNLTPATLTAP

SEQ ID NO: 8349 - protein, 19 aa, Artificial Sequence
  Description of Artificial Sequence: Synthetic peptide
TSGRAPEATNLAPAPLTGP

SEQ ID NO: 8350 - protein, 19 aa, Artificial Sequence
  Description of Artificial Sequence: Synthetic peptide
TQGRAAEAANLTPAGLTEP

SEQ ID NO: 8351 - protein, 19 aa, Artificial Sequence
  Description of Artificial Sequence: Synthetic peptide
TTGRAGSAPNLPPTGLTTP

SEQ ID NO: 8352 - protein, 19 aa, Artificial Sequence
  Description of Artificial Sequence: Synthetic peptide
TTGRAGGAENLPPEGLTAP

SEQ ID NO: 8353 - protein, 19 aa, Artificial Sequence
  Description of Artificial Sequence: Synthetic peptide
TTSRAGTATNLTPEGLTAP

SEQ ID NO: 8354 - protein, 19 aa, Artificial Sequence
  Description of Artificial Sequence: Synthetic peptide
TTGRAGTATNLPPSGLTTP

SEQ ID NO: 8355 - protein, 19 aa, Artificial Sequence
  Description of Artificial Sequence: Synthetic peptide
TTARAGEAENLSPSGLTAP

SEQ ID NO: 8356 - protein, 19 aa, Artificial Sequence
  Description of Artificial Sequence: Synthetic peptide
TTGRAGGAGNLAPGGLTEP

SEQ ID NO: 8357 - protein, 19 aa, Artificial Sequence
  Description of Artificial Sequence: Synthetic peptide
TTGRAGTATNLPPEGLTGP

SEQ ID NO: 8358 - protein, 19 aa, Artificial Sequence
  Description of Artificial Sequence: Synthetic peptide
TTGRAGGAANLAPTGLTEP

SEQ ID NO: 8359 - protein, 19 aa, Artificial Sequence
  Description of Artificial Sequence: Synthetic peptide
TTGRAGTAENLAPSGLTTP

SEQ ID NO: 8360 - protein, 19 aa, Artificial Sequence
  Description of Artificial Sequence: Synthetic peptide
TTGRAGSATNLGPGGLTGP

SEQ ID NO: 8361 - protein, 19 aa, Artificial Sequence
  Description of Artificial Sequence: Synthetic peptide
TTARAGGAENLTPAGLTEP

SEQ ID NO: 8362 - protein, 19 aa, Artificial Sequence
  Description of Artificial Sequence: Synthetic peptide
TTARAGSAENLSPSGLTGP

SEQ ID NO: 8363 - protein, 19 aa, Artificial Sequence
  Description of Artificial Sequence: Synthetic peptide
TTARAGGAGNLAPEGLTTP

SEQ ID NO: 8364 - protein, 19 aa, Artificial Sequence
  Description of Artificial Sequence: Synthetic peptide
TTSRAGAAENLTPTGLTGP

SEQ ID NO: 8365 - protein, 19 aa, Artificial Sequence
  Description of Artificial Sequence: Synthetic peptide
TYGRTTTPGNEPPASLEAE

SEQ ID NO: 8366 - protein, 19 aa, Artificial Sequence
  Description of Artificial Sequence: Synthetic peptide
TYSRGESGPNEPPPGLTGP

SEQ ID NO: 8367 - protein, 19 aa, Artificial Sequence
  Description of Artificial Sequence: Synthetic peptide
AWGRTGASENETPAPLGGE

SEQ ID NO: 8368 - protein, 19 aa, Artificial Sequence
  Description of Artificial Sequence: Synthetic peptide
RWGRAETTPNTPPEGLETE

SEQ ID NO: 8369 - protein, 19 aa, Artificial Sequence
  Description of Artificial Sequence: Synthetic peptide
ESGRAANHTGAEPPELGAG

SEQ ID NO: 8370 - protein, 19 aa, Artificial Sequence
  Description of Artificial Sequence: Synthetic peptide
TTGRAGEAANLTPAGLTES

SEQ ID NO: 8371 - protein, 19 aa, Artificial Sequence
  Description of Artificial Sequence: Synthetic peptide
TTGRAGEAANLTPAALTES

SEQ ID NO: 8372 - protein, 19 aa, Artificial Sequence
  Description of Artificial Sequence: Synthetic peptide
TTGRAGEAANLTPAPLTES

SEQ ID NO: 8373 - protein, 19 aa, Artificial Sequence
  Description of Artificial Sequence: Synthetic peptide
TTGRAGEAANLTPEPLTES

SEQ ID NO: 8374 - protein, 19 aa, Artificial Sequence
  Description of Artificial Sequence: Synthetic peptide
TTGRAGEAANLTPAGLTGA

SEQ ID NO: 8375 - protein, 19 aa, Artificial Sequence
  Description of Artificial Sequence: Synthetic peptide
TTGRAGEAANLTPEGLTGA

SEQ ID NO: 8376 - protein, 19 aa, Artificial Sequence
  Description of Artificial Sequence: Synthetic peptide
TTGRAGEAANLTPEPLTGA

SEQ ID NO: 8377 - protein, 19 aa, Artificial Sequence
  Description of Artificial Sequence: Synthetic peptide
TTGRAGEAANLTPAGLTEA

SEQ ID NO: 8378 - protein, 19 aa, Artificial Sequence
  Description of Artificial Sequence: Synthetic peptide
TTGRAGEAANLTPEGLTEA

SEQ ID NO: 8379 - protein, 19 aa, Artificial Sequence
  Description of Artificial Sequence: Synthetic peptide
TTGRAGEAANLTPAPLTEA

SEQ ID NO: 8380 - protein, 19 aa, Artificial Sequence
  Description of Artificial Sequence: Synthetic peptide
TTGRAGEAANLTPEPLTEA

SEQ ID NO: 8381 - protein, 19 aa, Artificial Sequence
  Description of Artificial Sequence: Synthetic peptide
TTGRAGEAANLTPEPLTGP

SEQ ID NO: 8382 - protein, 19 aa, Artificial Sequence
  Description of Artificial Sequence: Synthetic peptide
TTGRAGEAANLTPAGLTGG

SEQ ID NO: 8383 - protein, 19 aa, Artificial Sequence
  Description of Artificial Sequence: Synthetic peptide
TTGRAGEAANLTPEGLTGG

SEQ ID NO: 8384 - protein, 19 aa, Artificial Sequence
  Description of Artificial Sequence: Synthetic peptide
TTGRAGEAANLTPEALTGG

SEQ ID NO: 8385 - protein, 19 aa, Artificial Sequence
  Description of Artificial Sequence: Synthetic peptide
TTGRAGEAANLTPEPLTGG

SEQ ID NO: 8386 - protein, 19 aa, Artificial Sequence
  Description of Artificial Sequence: Synthetic peptide
TTGRAGEAANLTPAGLTEG

SEQ ID NO: 8387 - protein, 19 aa, Artificial Sequence
  Description of Artificial Sequence: Synthetic peptide
TTGRAGEAANLTPEGLTEG

SEQ ID NO: 8388 - protein, 19 aa, Artificial Sequence
  Description of Artificial Sequence: Synthetic peptide
TTGRAGEAANLTPAPLTEG

SEQ ID NO: 8389 - protein, 19 aa, Artificial Sequence
  Description of Artificial Sequence: Synthetic peptide
TTGRAGEAANLTPEPLTEG

SEQ ID NO: 8390 - protein, 29 aa, Artificial Sequence
  Description of Artificial Sequence: Synthetic peptide
GSAPGSAGGYAELRMGGAIATSGSETPGT

SEQ ID NO: 8391 - protein, 29 aa, Artificial Sequence
  Description of Artificial Sequence: Synthetic peptide
GSAPGTGGGYAPLRMGGGAATSGSETPGT

SEQ ID NO: 8392 - protein, 29 aa, Artificial Sequence
  Description of Artificial Sequence: Synthetic peptide
GSAPGAEGGYAALRMGGEIATSGSETPGT

SEQ ID NO: 8393 - protein, 29 aa, Artificial Sequence
  Description of Artificial Sequence: Synthetic peptide
GSAPGGPGGYALLRMGGPAATSGSETPGT

SEQ ID NO: 8394 - protein, 29 aa, Artificial Sequence
  Description of Artificial Sequence: Synthetic peptide
GSAPGEAGGYAFLRMGGSIATSGSETPGT

SEQ ID NO: 8395 - protein, 29 aa, Artificial Sequence
  Description of Artificial Sequence: Synthetic peptide
GSAPGPGGGYASLRMGGTAATSGSETPGT

SEQ ID NO: 8396 - protein, 29 aa, Artificial Sequence
  Description of Artificial Sequence: Synthetic peptide
GSAPGSEGGYATLRMGGAIATSGSETPGT

SEQ ID NO: 8397 - protein, 29 aa, Artificial Sequence
  Description of Artificial Sequence: Synthetic peptide
GSAPGTPGGYANLRMGGGAATSGSETPGT

SEQ ID NO: 8398 - protein, 29 aa, Artificial Sequence
  Description of Artificial Sequence: Synthetic peptide
GSAPGASGGYAHLRMGGEIATSGSETPGT

SEQ ID NO: 8399 - protein, 29 aa, Artificial Sequence
  Description of Artificial Sequence: Synthetic peptide
GSAPGGTGGYGELRMGGPAATSGSETPGT

SEQ ID NO: 8400 - protein, 29 aa, Artificial Sequence
  Description of Artificial Sequence: Synthetic peptide
GSAPGEAGGYPELRMGGSIATSGSETPGT

SEQ ID NO: 8401 - protein, 29 aa, Artificial Sequence
  Description of Artificial Sequence: Synthetic peptide
GSAPGPGGGYVELRMGGTAATSGSETPGT

SEQ ID NO: 8402 - protein, 29 aa, Artificial Sequence
  Description of Artificial Sequence: Synthetic peptide
GSAPGSEGGYLELRMGGAIATSGSETPGT

SEQ ID NO: 8403 - protein, 29 aa, Artificial Sequence
  Description of Artificial Sequence: Synthetic peptide
GSAPGTPGGYSELRMGGGAATSGSETPGT

SEQ ID NO: 8404 - protein, 29 aa, Artificial Sequence
  Description of Artificial Sequence: Synthetic peptide
GSAPGASGGYTELRMGGEIATSGSETPGT

SEQ ID NO: 8405 - protein, 29 aa, Artificial Sequence
  Description of Artificial Sequence: Synthetic peptide
GSAPGGTGGYQELRMGGPAATSGSETPGT

SEQ ID NO: 8406 - protein, 29 aa, Artificial Sequence
  Description of Artificial Sequence: Synthetic peptide
GSAPGEAGGYEELRMGGSIATSGSETPGT

SEQ ID NO: 8407 - protein, 29 aa, Artificial Sequence
  Description of Artificial Sequence: Synthetic peptide
GSAPGPGIGPAELRMGGTAATSGSETPGT

SEQ ID NO: 8408 - protein, 29 aa, Artificial Sequence
  Description of Artificial Sequence: Synthetic peptide
GSAPGSEIGAAELRMGGAIATSGSETPGT

SEQ ID NO: 8409 - protein, 29 aa, Artificial Sequence
  Description of Artificial Sequence: Synthetic peptide
GSAPGTPIGSAELRMGGGAATSGSETPGT

SEQ ID NO: 8410 - protein, 29 aa, Artificial Sequence
  Description of Artificial Sequence: Synthetic peptide
GSAPGASIGTAELRMGGEIATSGSETPGT

SEQ ID NO: 8411 - protein, 29 aa, Artificial Sequence
  Description of Artificial Sequence: Synthetic peptide
GSAPGGTIGNAELRMGGPAATSGSETPGT

SEQ ID NO: 8412 - protein, 29 aa, Artificial Sequence
  Description of Artificial Sequence: Synthetic peptide
GSAPGEAIGQAELRMGGSIATSGSETPGT

SEQ ID NO: 8413 - protein, 29 aa, Artificial Sequence
  Description of Artificial Sequence: Synthetic peptide
GSAPGPGGPYAELRMGGTAATSGSETPGT

SEQ ID NO: 8414 - protein, 29 aa, Artificial Sequence
  Description of Artificial Sequence: Synthetic peptide
GSAPGSEGAYAELRMGGAIATSGSETPGT

SEQ ID NO: 8415 - protein, 29 aa, Artificial Sequence
  Description of Artificial Sequence: Synthetic peptide
GSAPGTPGVYAELRMGGGAATSGSETPGT

SEQ ID NO: 8416 - protein, 29 aa, Artificial Sequence
  Description of Artificial Sequence: Synthetic peptide
GSAPGASGLYAELRMGGEIATSGSETPGT

SEQ ID NO: 8417 - protein, 29 aa, Artificial Sequence
  Description of Artificial Sequence: Synthetic peptide
GSAPGGTGIYAELRMGGPAATSGSETPGT

SEQ ID NO: 8418 - protein, 29 aa, Artificial Sequence
  Description of Artificial Sequence: Synthetic peptide
GSAPGEAGFYAELRMGGSIATSGSETPGT

SEQ ID NO: 8419 - protein, 29 aa, Artificial Sequence
  Description of Artificial Sequence: Synthetic peptide
GSAPGPGGYYAELRMGGTAATSGSETPGT

SEQ ID NO: 8420 - protein, 29 aa, Artificial Sequence
  Description of Artificial Sequence: Synthetic peptide
GSAPGSEGSYAELRMGGAIATSGSETPGT

SEQ ID NO: 8421 - protein, 29 aa, Artificial Sequence
  Description of Artificial Sequence: Synthetic peptide
GSAPGTPGNYAELRMGGGAATSGSETPGT

SEQ ID NO: 8422 - protein, 29 aa, Artificial Sequence
  Description of Artificial Sequence: Synthetic peptide
GSAPGASGEYAELRMGGEIATSGSETPGT

SEQ ID NO: 8423 - protein, 29 aa, Artificial Sequence
  Description of Artificial Sequence: Synthetic peptide
GSAPGGTGHYAELRMGGPAATSGSETPGT

SEQ ID NO: 8424 - protein, 29 aa, Artificial Sequence
  Description of Artificial Sequence: Synthetic peptide
GSAPGEAGGYAEARMGGSIATSGSETPGT

SEQ ID NO: 8425 - protein, 29 aa, Artificial Sequence
  Description of Artificial Sequence: Synthetic peptide
GSAPGPGGGYAEVRMGGTAATSGSETPGT

SEQ ID NO: 8426 - protein, 29 aa, Artificial Sequence
  Description of Artificial Sequence: Synthetic peptide
GSAPGSEGGYAEIRMGGAIATSGSETPGT

SEQ ID NO: 8427 - protein, 29 aa, Artificial Sequence
  Description of Artificial Sequence: Synthetic peptide
GSAPGTPGGYAEFRMGGGAATSGSETPGT

SEQ ID NO: 8428 - protein, 29 aa, Artificial Sequence
  Description of Artificial Sequence: Synthetic peptide
GSAPGASGGYAEYRMGGEIATSGSETPGT

SEQ ID NO: 8429 - protein, 29 aa, Artificial Sequence
  Description of Artificial Sequence: Synthetic peptide
GSAPGGTGGYAESRMGGPAATSGSETPGT

SEQ ID NO: 8430 - protein, 29 aa, Artificial Sequence
  Description of Artificial Sequence: Synthetic peptide
GSAPGEAGGYAETRMGGSIATSGSETPGT

SEQ ID NO: 8431 - protein, 29 aa, Artificial Sequence
  Description of Artificial Sequence: Synthetic peptide
GSAPGPGGGYAELAMGGTRATSGSETPGT

SEQ ID NO: 8432 - protein, 29 aa, Artificial Sequence
  Description of Artificial Sequence: Synthetic peptide
GSAPGSEGGYAELVMGGARATSGSETPGT

SEQ ID NO: 8433 - protein, 29 aa, Artificial Sequence
  Description of Artificial Sequence: Synthetic peptide
GSAPGTPGGYAELLMGGGRATSGSETPGT

SEQ ID NO: 8434 - protein, 29 aa, Artificial Sequence
  Description of Artificial Sequence: Synthetic peptide
GSAPGASGGYAELIMGGERATSGSETPGT

SEQ ID NO: 8435 - protein, 29 aa, Artificial Sequence
  Description of Artificial Sequence: Synthetic peptide
GSAPGGTGGYAELWMGGPRATSGSETPGT

SEQ ID NO: 8436 - protein, 29 aa, Artificial Sequence
  Description of Artificial Sequence: Synthetic peptide
GSAPGEAGGYAELSMGGSRATSGSETPGT

SEQ ID NO: 8437 - protein, 29 aa, Artificial Sequence
  Description of Artificial Sequence: Synthetic peptide
GSAPGPGGGYAELTMGGTRATSGSETPGT

SEQ ID NO: 8438 - protein, 29 aa, Artificial Sequence
  Description of Artificial Sequence: Synthetic peptide
GSAPGSEGGYAELQMGGARATSGSETPGT

SEQ ID NO: 8439 - protein, 29 aa, Artificial Sequence
  Description of Artificial Sequence: Synthetic peptide
GSAPGTPGGYAELNMGGGRATSGSETPGT

SEQ ID NO: 8440 - protein, 29 aa, Artificial Sequence
  Description of Artificial Sequence: Synthetic peptide
GSAPGASGGYAELEMGGERATSGSETPGT

SEQ ID NO: 8441 - protein, 29 aa, Artificial Sequence
  Description of Artificial Sequence: Synthetic peptide
GSAPGGTGGYAELRPGGPIATSGSETPGT

SEQ ID NO: 8442 - protein, 29 aa, Artificial Sequence
  Description of Artificial Sequence: Synthetic peptide
GSAPGEAGGYAELRAGGSAATSGSETPGT

SEQ ID NO: 8443 - protein, 29 aa, Artificial Sequence
  Description of Artificial Sequence: Synthetic peptide
GSAPGPGGGYAELRLGGTIATSGSETPGT

SEQ ID NO: 8444 - protein, 29 aa, Artificial Sequence
  Description of Artificial Sequence: Synthetic peptide
GSAPGSEGGYAELRIGGAAATSGSETPGT

SEQ ID NO: 8445 - protein, 29 aa, Artificial Sequence
  Description of Artificial Sequence: Synthetic peptide
GSAPGTPGGYAELRSGGGIATSGSETPGT

SEQ ID NO: 8446 - protein, 29 aa, Artificial Sequence
  Description of Artificial Sequence: Synthetic peptide
GSAPGASGGYAELRNGGEAATSGSETPGT

SEQ ID NO: 8447 - protein, 29 aa, Artificial Sequence
  Description of Artificial Sequence: Synthetic peptide
GSAPGGTGGYAELRQGGPIATSGSETPGT

SEQ ID NO: 8448 - protein, 29 aa, Artificial Sequence
  Description of Artificial Sequence: Synthetic peptide
GSAPGEAGGYAELRDGGSAATSGSETPGT

SEQ ID NO: 8449 - protein, 29 aa, Artificial Sequence
  Description of Artificial Sequence: Synthetic peptide
GSAPGPGGGYAELREGGTIATSGSETPGT

SEQ ID NO: 8450 - protein, 29 aa, Artificial Sequence
  Description of Artificial Sequence: Synthetic peptide
GSAPGSEGGYAELRHGGAAATSGSETPGT

SEQ ID NO: 8451 - protein, 29 aa, Artificial Sequence
  Description of Artificial Sequence: Synthetic peptide
GSAPGTPGGYAELRMPGGIATSGSETPGT

SEQ ID NO: 8452 - protein, 29 aa, Artificial Sequence
  Description of Artificial Sequence: Synthetic peptide
GSAPGASGGYAELRMAGEAATSGSETPGT

SEQ ID NO: 8453 - protein, 29 aa, Artificial Sequence
  Description of Artificial Sequence: Synthetic peptide
GSAPGGTGGYAELRMVGPIATSGSETPGT

SEQ ID NO: 8454 - protein, 29 aa, Artificial Sequence
  Description of Artificial Sequence: Synthetic peptide
GSAPGEAGGYAELRMLGSAATSGSETPGT

SEQ ID NO: 8455 - protein, 29 aa, Artificial Sequence
  Description of Artificial Sequence: Synthetic peptide
GSAPGPGGGYAELRMIGTIATSGSETPGT

SEQ ID NO: 8456 - protein, 29 aa, Artificial Sequence
  Description of Artificial Sequence: Synthetic peptide
GSAPGSEGGYAELRMYGAIATSGSETPGT

SEQ ID NO: 8457 - protein, 29 aa, Artificial Sequence
  Description of Artificial Sequence: Synthetic peptide
GSAPGTPGGYAELRMSGGAATSGSETPGT

SEQ ID NO: 8458 - protein, 29 aa, Artificial Sequence
  Description of Artificial Sequence: Synthetic peptide
GSAPGASGGYAELRMNGEIATSGSETPGT

SEQ ID NO: 8459 - protein, 29 aa, Artificial Sequence
  Description of Artificial Sequence: Synthetic peptide
GSAPGGTGGYAELRMQGPAATSGSETPGT

SEQ ID NO: 8460 - protein, 29 aa, Artificial Sequence
  Description of Artificial Sequence: Synthetic peptide
GSAPGANHTPAGLTGPGARATSGSETPGT

SEQ ID NO: 8461 - protein, 29 aa, Artificial Sequence
  Description of Artificial Sequence: Synthetic peptide
GSAPGANTAPEGLTGPSTRATSGSETPGT

SEQ ID NO: 8462 - protein, 29 aa, Artificial Sequence
  Description of Artificial Sequence: Synthetic peptide
GSAPGTGAPPGGLTGPGTRATSGSETPGT

SEQ ID NO: 8463 - protein, 29 aa, Artificial Sequence
  Description of Artificial Sequence: Synthetic peptide
GSAPGANHEPSGLTEGSPRATSGSETPGT

SEQ ID NO: 8464 - protein, 29 aa, Artificial Sequence
  Description of Artificial Sequence: Synthetic peptide
GSAPGANTEPPELGAGTERATSGSETPGT

SEQ ID NO: 8465 - protein, 29 aa, Artificial Sequence
  Description of Artificial Sequence: Synthetic peptide
GSAPGASGPPPGLTGPPGRATSGSETPGT

SEQ ID NO: 8466 - protein, 29 aa, Artificial Sequence
  Description of Artificial Sequence: Synthetic peptide
GSAPGASGTPAPLGGEPGRATSGSETPGT

SEQ ID NO: 8467 - protein, 29 aa, Artificial Sequence
  Description of Artificial Sequence: Synthetic peptide
GSAPGPAGPPEGLETEAGRATSGSETPGT

SEQ ID NO: 8468 - protein, 29 aa, Artificial Sequence
  Description of Artificial Sequence: Synthetic peptide
GSAPGPTSGQGGLTGPESRATSGSETPGT

SEQ ID NO: 8469 - protein, 29 aa, Artificial Sequence
  Description of Artificial Sequence: Synthetic peptide
GSAPGSAGGAANLVRGGAIATSGSETPGT

SEQ ID NO: 8470 - protein, 29 aa, Artificial Sequence
  Description of Artificial Sequence: Synthetic peptide
GSAPGTGGGAAPLVRGGGAATSGSETPGT

SEQ ID NO: 8471 - protein, 29 aa, Artificial Sequence
  Description of Artificial Sequence: Synthetic peptide
GSAPGAEGGAAALVRGGEIATSGSETPGT

SEQ ID NO: 8472 - protein, 29 aa, Artificial Sequence
  Description of Artificial Sequence: Synthetic peptide
GSAPGGPGGAALLVRGGPAATSGSETPGT

SEQ ID NO: 8473 - protein, 29 aa, Artificial Sequence
  Description of Artificial Sequence: Synthetic peptide
GSAPGEAGGAAFLVRGGSIATSGSETPGT

SEQ ID NO: 8474 - protein, 29 aa, Artificial Sequence
  Description of Artificial Sequence: Synthetic peptide
GSAPGPGGGAASLVRGGTAATSGSETPGT

SEQ ID NO: 8475 - protein, 29 aa, Artificial Sequence
  Description of Artificial Sequence: Synthetic peptide
GSAPGSEGGAATLVRGGAIATSGSETPGT

SEQ ID NO: 8476 - protein, 29 aa, Artificial Sequence
  Description of Artificial Sequence: Synthetic peptide
GSAPGTPGGAAGLVRGGGAATSGSETPGT

SEQ ID NO: 8477 - protein, 29 aa, Artificial Sequence
  Description of Artificial Sequence: Synthetic peptide
GSAPGASGGAADLVRGGEIATSGSETPGT

SEQ ID NO: 8478 - protein, 29 aa, Artificial Sequence
  Description of Artificial Sequence: Synthetic peptide
GSAPGGTGGAGNLVRGGPAATSGSETPGT

SEQ ID NO: 8479 - protein, 29 aa, Artificial Sequence
  Description of Artificial Sequence: Synthetic peptide
GSAPGEAGGAPNLVRGGSIATSGSETPGT

SEQ ID NO: 8480 - protein, 29 aa, Artificial Sequence
  Description of Artificial Sequence: Synthetic peptide
GSAPGPGGGAVNLVRGGTAATSGSETPGT

SEQ ID NO: 8481 - protein, 29 aa, Artificial Sequence
  Description of Artificial Sequence: Synthetic peptide
GSAPGSEGGALNLVRGGAIATSGSETPGT

SEQ ID NO: 8482 - protein, 29 aa, Artificial Sequence
  Description of Artificial Sequence: Synthetic peptide
GSAPGTPGGASNLVRGGGAATSGSETPGT

SEQ ID NO: 8483 - protein, 29 aa, Artificial Sequence
  Description of Artificial Sequence: Synthetic peptide
GSAPGASGGATNLVRGGEIATSGSETPGT

SEQ ID NO: 8484 - protein, 29 aa, Artificial Sequence
  Description of Artificial Sequence: Synthetic peptide
GSAPGGTGGAQNLVRGGPAATSGSETPGT

SEQ ID NO: 8485 - protein, 29 aa, Artificial Sequence
  Description of Artificial Sequence: Synthetic peptide
GSAPGEAGGAENLVRGGSIATSGSETPGT

SEQ ID NO: 8486 - protein, 30 aa, Artificial Sequence
  Description of Artificial Sequence: Synthetic polypeptide
GSAPEAGRSANHEPLGLVATATSGSETPGT

SEQ ID NO: 8487 - protein, 30 aa, Artificial Sequence
  Description of Artificial Sequence: Synthetic polypeptide
GSAPASGRSTNAGPSGLAGPATSGSETPGT

SEQ ID NO: 8488 - protein, 30 aa, Artificial Sequence
  Description of Artificial Sequence: Synthetic polypeptide
GSAPASGRSTNAGPQGLAGQATSGSETPGT

SEQ ID NO: 8489 - protein, 30 aa, Artificial Sequence
  Description of Artificial Sequence: Synthetic polypeptide
GSAPASGRSTNAGPPGLTGPATSGSETPGT

SEQ ID NO: 8490 - protein, 30 aa, Artificial Sequence
  Description of Artificial Sequence: Synthetic polypeptide
GSAPASSRGTNAGPAGLTGPATSGSETPGT

SEQ ID NO: 8491 - protein, 30 aa, Artificial Sequence
  Description of Artificial Sequence: Synthetic polypeptide
GSAPASSRTTNTGPSTLTGPATSGSETPGT

SEQ ID NO: 8492 - protein, 30 aa, Artificial Sequence
  Description of Artificial Sequence: Synthetic polypeptide
GSAPAAGRSDNGTPLELVAPATSGSETPGT

SEQ ID NO: 8493 - protein, 30 aa, Artificial Sequence
  Description of Artificial Sequence: Synthetic polypeptide
GSAPASGRGTNAGPAGLTGPATSGSETPGT

SEQ ID NO: 8494 - protein, 30 aa, Artificial Sequence
  Description of Artificial Sequence: Synthetic polypeptide
GSAPLFGRNDNHEPLELGGGATSGSETPGT

SEQ ID NO: 8495 - protein, 30 aa, Artificial Sequence
  Description of Artificial Sequence: Synthetic polypeptide
GSAPTAGRSDNLEPLGLVFGATSGSETPGT

SEQ ID NO: 8496 - protein, 30 aa, Artificial Sequence
  Description of Artificial Sequence: Synthetic polypeptide
GSAPLDGRSDNFHPPELVAGATSGSETPGT

SEQ ID NO: 8497 - protein, 30 aa, Artificial Sequence
  Description of Artificial Sequence: Synthetic polypeptide
GSAPLEGRSDNEEPENLVAGATSGSETPGT

SEQ ID NO: 8498 - protein, 30 aa, Artificial Sequence
  Description of Artificial Sequence: Synthetic polypeptide
GSAPLKGRSDNNAPLALVAGATSGSETPGT

SEQ ID NO: 8499 - protein, 30 aa, Artificial Sequence
  Description of Artificial Sequence: Synthetic polypeptide
GSAPVYSRGTNAGPHGLTGRATSGSETPGT

SEQ ID NO: 8500 - protein, 30 aa, Artificial Sequence
  Description of Artificial Sequence: Synthetic polypeptide
GSAPANSRGTNKGFAGLIGPATSGSETPGT

SEQ ID NO: 8501 - protein, 30 aa, Artificial Sequence
  Description of Artificial Sequence: Synthetic polypeptide
GSAPASSRLTNEAPAGLTIPATSGSETPGT

SEQ ID NO: 8502 - protein, 30 aa, Artificial Sequence
  Description of Artificial Sequence: Synthetic polypeptide
GSAPDQSRGTNAGPEGLTDPATSGSETPGT

SEQ ID NO: 8503 - protein, 30 aa, Artificial Sequence
  Description of Artificial Sequence: Synthetic polypeptide
GSAPESSRGTNIGQGGLTGPATSGSETPGT

SEQ ID NO: 8504 - protein, 30 aa, Artificial Sequence
  Description of Artificial Sequence: Synthetic polypeptide
GSAPSSSRGTNQDPAGLTIPATSGSETPGT

SEQ ID NO: 8505 - protein, 30 aa, Artificial Sequence
  Description of Artificial Sequence: Synthetic polypeptide
GSAPASSRGQNHSPMGLTGPATSGSETPGT

SEQ ID NO: 8506 - protein, 30 aa, Artificial Sequence
  Description of Artificial Sequence: Synthetic polypeptide
GSAPAYSRGPNAGPAGLEGRATSGSETPGT

SEQ ID NO: 8507 - protein, 30 aa, Artificial Sequence
  Description of Artificial Sequence: Synthetic polypeptide
GSAPASERGNNAGPANLTGFATSGSETPGT

SEQ ID NO: 8508 - protein, 30 aa, Artificial Sequence
  Description of Artificial Sequence: Synthetic polypeptide
GSAPASHRGTNPKPAILTGPATSGSETPGT

SEQ ID NO: 8509 - protein, 30 aa, Artificial Sequence
  Description of Artificial Sequence: Synthetic polypeptide
GSAPMSSRRTNANPAQLTGPATSGSETPGT

SEQ ID NO: 8510 - protein, 30 aa, Artificial Sequence
  Description of Artificial Sequence: Synthetic polypeptide
GSAPGAGRTDNHEPLELGAAATSGSETPGT

SEQ ID NO: 8511 - protein, 30 aa, Artificial Sequence
  Description of Artificial Sequence: Synthetic polypeptide
GSAPLAGRSENTAPLELTAGATSGSETPGT

SEQ ID NO: 8512 - protein, 30 aa, Artificial Sequence
  Description of Artificial Sequence: Synthetic polypeptide
GSAPLEGRPDNHEPLALVASATSGSETPGT

SEQ ID NO: 8513 - protein, 30 aa, Artificial Sequence
  Description of Artificial Sequence: Synthetic polypeptide
GSAPLSGRSDNEEPLALPAGATSGSETPGT

SEQ ID NO: 8514 - protein, 30 aa, Artificial Sequence
  Description of Artificial Sequence: Synthetic polypeptide
GSAPEAGRTDNHEPLELSAPATSGSETPGT

SEQ ID NO: 8515 - protein, 30 aa, Artificial Sequence
  Description of Artificial Sequence: Synthetic polypeptide
GSAPEGGRSDNHGPLELVSGATSGSETPGT

SEQ ID NO: 8516 - protein, 30 aa, Artificial Sequence
  Description of Artificial Sequence: Synthetic polypeptide
GSAPLSGRSDNEAPLELEAGATSGSETPGT

SEQ ID NO: 8517 - protein, 30 aa, Artificial Sequence
  Description of Artificial Sequence: Synthetic polypeptide
GSAPLGGRADNHEPPELGAGATSGSETPGT

SEQ ID NO: 8518 - protein, 30 aa, Artificial Sequence
  Description of Artificial Sequence: Synthetic polypeptide
GSAPPPSRGTNAEPAGLTGEATSGSETPGT

SEQ ID NO: 8519 - protein, 30 aa, Artificial Sequence
  Description of Artificial Sequence: Synthetic polypeptide
GSAPASTRGENAGPAGLEAPATSGSETPGT

SEQ ID NO: 8520 - protein, 30 aa, Artificial Sequence
  Description of Artificial Sequence: Synthetic polypeptide
GSAPESSRGTNGAPEGLTGPATSGSETPGT

SEQ ID NO: 8521 - protein, 30 aa, Artificial Sequence
  Description of Artificial Sequence: Synthetic polypeptide
GSAPASSRATNESPAGLTGEATSGSETPGT

SEQ ID NO: 8522 - protein, 30 aa, Artificial Sequence
  Description of Artificial Sequence: Synthetic polypeptide
GSAPASSRGENPPPGGLTGPATSGSETPGT

SEQ ID NO: 8523 - protein, 30 aa, Artificial Sequence
  Description of Artificial Sequence: Synthetic polypeptide
GSAPAASRGTNTGPAELTGSATSGSETPGT

SEQ ID NO: 8524 - protein, 30 aa, Artificial Sequence
  Description of Artificial Sequence: Synthetic polypeptide
GSAPAGSRTTNAGPGGLEGPATSGSETPGT

SEQ ID NO: 8525 - protein, 30 aa, Artificial Sequence
  Description of Artificial Sequence: Synthetic polypeptide
GSAPAPSRGENAGPATLTGAATSGSETPGT

SEQ ID NO: 8526 - protein, 30 aa, Artificial Sequence
  Description of Artificial Sequence: Synthetic polypeptide
GSAPESGRAANTGPPTLTAPATSGSETPGT

SEQ ID NO: 8527 - protein, 30 aa, Artificial Sequence
  Description of Artificial Sequence: Synthetic polypeptide
GSAPNPGRAANEGPPGLPGSATSGSETPGT

SEQ ID NO: 8528 - protein, 30 aa, Artificial Sequence
  Description of Artificial Sequence: Synthetic polypeptide
GSAPESSRAANLTPPELTGPATSGSETPGT

SEQ ID NO: 8529 - protein, 30 aa, Artificial Sequence
  Description of Artificial Sequence: Synthetic polypeptide
GSAPASGRAANETPPGLTGAATSGSETPGT

SEQ ID NO: 8530 - protein, 30 aa, Artificial Sequence
  Description of Artificial Sequence: Synthetic polypeptide
GSAPNSGRGENLGAPGLTGTATSGSETPGT

SEQ ID NO: 8531 - protein, 30 aa, Artificial Sequence
  Description of Artificial Sequence: Synthetic polypeptide
GSAPTTGRAANLTPAGLTGPATSGSETPGT

SEQ ID NO: 8532 - protein, 30 aa, Artificial Sequence
  Description of Artificial Sequence: Synthetic polypeptide
GSAPEAGRSANHTPAGLTGPATSGSETPGT

SEQ ID NO: 8533 - protein, 30 aa, Artificial Sequence
  Description of Artificial Sequence: Synthetic polypeptide
GSAPESGRAANTTPAGLTGPATSGSETPGT

SEQ ID NO: 8534 - protein, 33 aa, Artificial Sequence
  Description of Artificial Sequence: Synthetic polypeptide
GSAPTTGRATEAANLTPAGLTGPATSGSETPGT

SEQ ID NO: 8535 - protein, 33 aa, Artificial Sequence
  Description of Artificial Sequence: Synthetic polypeptide
GSAPTTGRAEEAANLTPAGLTGPATSGSETPGT

SEQ ID NO: 8536 - protein, 33 aa, Artificial Sequence
  Description of Artificial Sequence: Synthetic polypeptide
GSAPTTGRAGEAANLTPAGLTGPATSGSETPGT

SEQ ID NO: 8537 - protein, 33 aa, Artificial Sequence
  Description of Artificial Sequence: Synthetic polypeptide
GSAPTTGRATEAANATPAGLTGPATSGSETPGT

SEQ ID NO: 8538 - protein, 33 aa, Artificial Sequence
  Description of Artificial Sequence: Synthetic polypeptide
GSAPTTGRAGEAEGATSAGATGPATSGSETPGT

SEQ ID NO: 8539 - protein, 33 aa, Artificial Sequence
  Description of Artificial Sequence: Synthetic polypeptide
GSAPTTGEAGEAANATSAGATGPATSGSETPGT

SEQ ID NO: 8540 - protein, 33 aa, Artificial Sequence
  Description of Artificial Sequence: Synthetic polypeptide
GSAPTTGEAGEAAGLTPAGLTGPATSGSETPGT

SEQ ID NO: 8541 - protein, 33 aa, Artificial Sequence
  Description of Artificial Sequence: Synthetic polypeptide
GSAPTTGAAGEAANATPAGLTGPATSGSETPGT

SEQ ID NO: 8542 - protein, 33 aa, Artificial Sequence
  Description of Artificial Sequence: Synthetic polypeptide
GSAPTTGRAGEAAGLTPAGLTGPATSGSETPGT

SEQ ID NO: 8543 - protein, 33 aa, Artificial Sequence
  Description of Artificial Sequence: Synthetic polypeptide
GSAPTTGRAGEAANATSAGATGPATSGSETPGT

SEQ ID NO: 8544 - protein, 33 aa, Artificial Sequence
  Description of Artificial Sequence: Synthetic polypeptide
GSAPTTGEAGEAAGATSAGATGPATSGSETPGT

SEQ ID NO: 8545 - protein, 30 aa, Artificial Sequence
  Description of Artificial Sequence: Synthetic polypeptide
GSAPESGRAANTEPPELGAGATSGSETPGT

SEQ ID NO: 8546 - protein, 30 aa, Artificial Sequence
  Description of Artificial Sequence: Synthetic polypeptide
GSAPESGRAANTAPEGLTGPATSGSETPGT

SEQ ID NO: 8547 - protein, 30 aa, Artificial Sequence
  Description of Artificial Sequence: Synthetic polypeptide
GSAPEPGRAANHEPSGLTEGATSGSETPGT

SEQ ID NO: 8548 - protein, 33 aa, Artificial Sequence
  Description of Artificial Sequence: Synthetic polypeptide
GSAPESGRAANHTGAPPGGLTGPATSGSETPGT

SEQ ID NO: 8549 - protein, 33 aa, Artificial Sequence
  Description of Artificial Sequence: Synthetic polypeptide
GSAPTTGRTGEGANATPGGLTGPATSGSETPGT

SEQ ID NO: 8550 - protein, 33 aa, Artificial Sequence
  Description of Artificial Sequence: Synthetic polypeptide
GSAPRTGRSGEAANETPEGLEGPATSGSETPGT

SEQ ID NO: 8551 - protein, 33 aa, Artificial Sequence
  Description of Artificial Sequence: Synthetic polypeptide
GSAPRTGRTGESANETPAGLGGPATSGSETPGT

SEQ ID NO: 8552 - protein, 33 aa, Artificial Sequence
  Description of Artificial Sequence: Synthetic polypeptide
GSAPSTGRTGEPANETPAGLSGPATSGSETPGT

SEQ ID NO: 8553 - protein, 33 aa, Artificial Sequence
  Description of Artificial Sequence: Synthetic polypeptide
GSAPTTGRAGEPANATPTGLSGPATSGSETPGT

SEQ ID NO: 8554 - protein, 33 aa, Artificial Sequence
  Description of Artificial Sequence: Synthetic polypeptide
GSAPRTGRPGEGANATPTGLPGPATSGSETPGT

SEQ ID NO: 8555 - protein, 33 aa, Artificial Sequence
  Description of Artificial Sequence: Synthetic polypeptide
GSAPRTGRGGEAANATPSGLGGPATSGSETPGT

SEQ ID NO: 8556 - protein, 33 aa, Artificial Sequence
  Description of Artificial Sequence: Synthetic polypeptide
GSAPSTGRSGESANATPGGLGGPATSGSETPGT

SEQ ID NO: 8557 - protein, 33 aa, Artificial Sequence
  Description of Artificial Sequence: Synthetic polypeptide
GSAPRTGRTGEEANATPAGLPGPATSGSETPGT

SEQ ID NO: 8558 - protein, 33 aa, Artificial Sequence
  Description of Artificial Sequence: Synthetic polypeptide
GSAPATGRPGEPANTTPEGLEGPATSGSETPGT

SEQ ID NO: 8559 - protein, 33 aa, Artificial Sequence
  Description of Artificial Sequence: Synthetic polypeptide
GSAPSTGRSGEPANATPGGLTGPATSGSETPGT

SEQ ID NO: 8560 - protein, 33 aa, Artificial Sequence
  Description of Artificial Sequence: Synthetic polypeptide
GSAPPTGRGGEGANTTPTGLPGPATSGSETPGT

SEQ ID NO: 8561 - protein, 33 aa, Artificial Sequence
  Description of Artificial Sequence: Synthetic polypeptide
GSAPPTGRSGEGANATPSGLTGPATSGSETPGT

SEQ ID NO: 8562 - protein, 33 aa, Artificial Sequence
  Description of Artificial Sequence: Synthetic polypeptide
GSAPTTGRASEGANSTPAPLTEPATSGSETPGT

SEQ ID NO: 8563 - protein, 33 aa, Artificial Sequence
  Description of Artificial Sequence: Synthetic polypeptide
GSAPTYGRAAEAANTTPAGLTAPATSGSETPGT

SEQ ID NO: 8564 - protein, 33 aa, Artificial Sequence
  Description of Artificial Sequence: Synthetic polypeptide
GSAPTTGRATEGANATPAELTEPATSGSETPGT

SEQ ID NO: 8565 - protein, 33 aa, Artificial Sequence
  Description of Artificial Sequence: Synthetic polypeptide
GSAPTVGRASEEANTTPASLTGPATSGSETPGT

SEQ ID NO: 8566 - protein, 33 aa, Artificial Sequence
  Description of Artificial Sequence: Synthetic polypeptide
GSAPTTGRAPEAANATPAPLTGPATSGSETPGT

SEQ ID NO: 8567 - protein, 33 aa, Artificial Sequence
  Description of Artificial Sequence: Synthetic polypeptide
GSAPTWGRATEPANATPAPLTSPATSGSETPGT

SEQ ID NO: 8568 - protein, 33 aa, Artificial Sequence
  Description of Artificial Sequence: Synthetic polypeptide
GSAPTVGRASESANATPAELTSPATSGSETPGT

SEQ ID NO: 8569 - protein, 33 aa, Artificial Sequence
  Description of Artificial Sequence: Synthetic polypeptide
GSAPTVGRAPEGANSTPAGLTGPATSGSETPGT

SEQ ID NO: 8570 - protein, 33 aa, Artificial Sequence
  Description of Artificial Sequence: Synthetic polypeptide
GSAPTWGRATEAPNLEPATLTTPATSGSETPGT

SEQ ID NO: 8571 - protein, 33 aa, Artificial Sequence
  Description of Artificial Sequence: Synthetic polypeptide
GSAPTTGRATEAPNLTPAPLTEPATSGSETPGT

SEQ ID NO: 8572 - protein, 33 aa, Artificial Sequence
  Description of Artificial Sequence: Synthetic polypeptide
GSAPTQGRATEAPNLSPAALTSPATSGSETPGT

SEQ ID NO: 8573 - protein, 33 aa, Artificial Sequence
  Description of Artificial Sequence: Synthetic polypeptide
GSAPTQGRAAEAPNLTPATLTAPATSGSETPGT

SEQ ID NO: 8574 - protein, 33 aa, Artificial Sequence
  Description of Artificial Sequence: Synthetic polypeptide
GSAPTSGRAPEATNLAPAPLTGPATSGSETPGT

SEQ ID NO: 8575 - protein, 33 aa, Artificial Sequence
  Description of Artificial Sequence: Synthetic polypeptide
GSAPTQGRAAEAANLTPAGLTEPATSGSETPGT

SEQ ID NO: 8576 - protein, 33 aa, Artificial Sequence
  Description of Artificial Sequence: Synthetic polypeptide
GSAPTTGRAGSAPNLPPTGLTTPATSGSETPGT

SEQ ID NO: 8577 - protein, 33 aa, Artificial Sequence
  Description of Artificial Sequence: Synthetic polypeptide
GSAPTTGRAGGAENLPPEGLTAPATSGSETPGT

SEQ ID NO: 8578 - protein, 33 aa, Artificial Sequence
  Description of Artificial Sequence: Synthetic polypeptide
GSAPTTSRAGTATNLTPEGLTAPATSGSETPGT

SEQ ID NO: 8579 - protein, 33 aa, Artificial Sequence
  Description of Artificial Sequence: Synthetic polypeptide
GSAPTTGRAGTATNLPPSGLTTPATSGSETPGT

SEQ ID NO: 8580 - protein, 33 aa, Artificial Sequence
  Description of Artificial Sequence: Synthetic polypeptide
GSAPTTARAGEAENLSPSGLTAPATSGSETPGT

SEQ ID NO: 8581 - protein, 33 aa, Artificial Sequence
  Description of Artificial Sequence: Synthetic polypeptide
GSAPTTGRAGGAGNLAPGGLTEPATSGSETPGT

SEQ ID NO: 8582 - protein, 33 aa, Artificial Sequence
  Description of Artificial Sequence: Synthetic polypeptide
GSAPTTGRAGTATNLPPEGLTGPATSGSETPGT

SEQ ID NO: 8583 - protein, 33 aa, Artificial Sequence
  Description of Artificial Sequence: Synthetic polypeptide
GSAPTTGRAGGAANLAPTGLTEPATSGSETPGT

SEQ ID NO: 8584 - protein, 33 aa, Artificial Sequence
  Description of Artificial Sequence: Synthetic polypeptide
GSAPTTGRAGTAENLAPSGLTTPATSGSETPGT

SEQ ID NO: 8585 - protein, 33 aa, Artificial Sequence
  Description of Artificial Sequence: Synthetic polypeptide
GSAPTTGRAGSATNLGPGGLTGPATSGSETPGT

SEQ ID NO: 8586 - protein, 33 aa, Artificial Sequence
  Description of Artificial Sequence: Synthetic polypeptide
GSAPTTARAGGAENLTPAGLTEPATSGSETPGT

SEQ ID NO: 8587 - protein, 33 aa, Artificial Sequence
  Description of Artificial Sequence: Synthetic polypeptide
GSAPTTARAGSAENLSPSGLTGPATSGSETPGT

SEQ ID NO: 8588 - protein, 33 aa, Artificial Sequence
  Description of Artificial Sequence: Synthetic polypeptide
GSAPTTARAGGAGNLAPEGLTTPATSGSETPGT

SEQ ID NO: 8589 - protein, 33 aa, Artificial Sequence
  Description of Artificial Sequence: Synthetic polypeptide
GSAPTTSRAGAAENLTPTGLTGPATSGSETPGT

SEQ ID NO: 8590 - protein, 33 aa, Artificial Sequence
  Description of Artificial Sequence: Synthetic polypeptide
GSAPTYGRTTTPGNEPPASLEAEATSGSETPGT

SEQ ID NO: 8591 - protein, 33 aa, Artificial Sequence
  Description of Artificial Sequence: Synthetic polypeptide
GSAPTYSRGESGPNEPPPGLTGPATSGSETPGT

SEQ ID NO: 8592 - protein, 33 aa, Artificial Sequence
  Description of Artificial Sequence: Synthetic polypeptide
GSAPAWGRTGASENETPAPLGGEATSGSETPGT

SEQ ID NO: 8593 - protein, 33 aa, Artificial Sequence
  Description of Artificial Sequence: Synthetic polypeptide
GSAPRWGRAETTPNTPPEGLETEATSGSETPGT

SEQ ID NO: 8594 - protein, 33 aa, Artificial Sequence
  Description of Artificial Sequence: Synthetic polypeptide
GSAPESGRAANHTGAEPPELGAGATSGSETPGT

SEQ ID NO: 8595 - protein, 33 aa, Artificial Sequence
  Description of Artificial Sequence: Synthetic polypeptide
GSAPTTGRAGEAANLTPAGLTESATSGSETPGT

SEQ ID NO: 8596 - protein, 33 aa, Artificial Sequence
  Description of Artificial Sequence: Synthetic polypeptide
GSAPTTGRAGEAANLTPAALTESATSGSETPGT

SEQ ID NO: 8597 - protein, 33 aa, Artificial Sequence
  Description of Artificial Sequence: Synthetic polypeptide
GSAPTTGRAGEAANLTPAPLTESATSGSETPGT

SEQ ID NO: 8598 - protein, 33 aa, Artificial Sequence
  Description of Artificial Sequence: Synthetic polypeptide
GSAPTTGRAGEAANLTPEPLTESATSGSETPGT

SEQ ID NO: 8599 - protein, 33 aa, Artificial Sequence
  Description of Artificial Sequence: Synthetic polypeptide
GSAPTTGRAGEAANLTPAGLTGAATSGSETPGT

SEQ ID NO: 8600 - protein, 33 aa, Artificial Sequence
  Description of Artificial Sequence: Synthetic polypeptide
GSAPTTGRAGEAANLTPEGLTGAATSGSETPGT

SEQ ID NO: 8601 - protein, 33 aa, Artificial Sequence
  Description of Artificial Sequence: Synthetic polypeptide
GSAPTTGRAGEAANLTPEPLTGAATSGSETPGT

SEQ ID NO: 8602 - protein, 33 aa, Artificial Sequence
  Description of Artificial Sequence: Synthetic polypeptide
GSAPTTGRAGEAANLTPAGLTEAATSGSETPGT

SEQ ID NO: 8603 - protein, 33 aa, Artificial Sequence
  Description of Artificial Sequence: Synthetic polypeptide
GSAPTTGRAGEAANLTPEGLTEAATSGSETPGT

SEQ ID NO: 8604 - protein, 33 aa, Artificial Sequence
  Description of Artificial Sequence: Synthetic polypeptide
GSAPTTGRAGEAANLTPAPLTEAATSGSETPGT

SEQ ID NO: 8605 - protein, 33 aa, Artificial Sequence
  Description of Artificial Sequence: Synthetic polypeptide
GSAPTTGRAGEAANLTPEPLTEAATSGSETPGT

SEQ ID NO: 8606 - protein, 33 aa, Artificial Sequence
  Description of Artificial Sequence: Synthetic polypeptide
GSAPTTGRAGEAANLTPEPLTGPATSGSETPGT

SEQ ID NO: 8607 - protein, 33 aa, Artificial Sequence
  Description of Artificial Sequence: Synthetic polypeptide
GSAPTTGRAGEAANLTPAGLTGGATSGSETPGT

SEQ ID NO: 8608 - protein, 33 aa, Artificial Sequence
  Description of Artificial Sequence: Synthetic polypeptide
GSAPTTGRAGEAANLTPEGLTGGATSGSETPGT

SEQ ID NO: 8609 - protein, 33 aa, Artificial Sequence
  Description of Artificial Sequence: Synthetic polypeptide
GSAPTTGRAGEAANLTPEALTGGATSGSETPGT

SEQ ID NO: 8610 - protein, 33 aa, Artificial Sequence
  Description of Artificial Sequence: Synthetic polypeptide
GSAPTTGRAGEAANLTPEPLTGGATSGSETPGT

SEQ ID NO: 8611 - protein, 33 aa, Artificial Sequence
  Description of Artificial Sequence: Synthetic polypeptide
GSAPTTGRAGEAANLTPAGLTEGATSGSETPGT

SEQ ID NO: 8612 - protein, 33 aa, Artificial Sequence
  Description of Artificial Sequence: Synthetic polypeptide
GSAPTTGRAGEAANLTPEGLTEGATSGSETPGT

SEQ ID NO: 8613 - protein, 33 aa, Artificial Sequence
  Description of Artificial Sequence: Synthetic polypeptide
GSAPTTGRAGEAANLTPAPLTEGATSGSETPGT

SEQ ID NO: 8614 - protein, 33 aa, Artificial Sequence
  Description of Artificial Sequence: Synthetic polypeptide
GSAPTTGRAGEAANLTPEPLTEGATSGSETPGT

SEQ ID NO: 8615 - protein, 30 aa, Artificial Sequence
  Description of Artificial Sequence: Synthetic polypeptide
GSAPEAGRSAEATSAGATGPATSGSETPGT

SEQ ID NO: 8616 - protein, 30 aa, Artificial Sequence
  Description of Artificial Sequence: Synthetic polypeptide
GSAPSASGTYSRGESGPGSPATSGSETPGT

SEQ ID NO: 8617 - protein, 30 aa, Artificial Sequence
  Description of Artificial Sequence: Synthetic polypeptide
GSAPSASGEAGRTDTHPGSPATSGSETPGT

SEQ ID NO: 8618 - protein, 30 aa, Artificial Sequence
  Description of Artificial Sequence: Synthetic polypeptide
GSAPSASGEPGRAAEHPGSPATSGSETPGT

SEQ ID NO: 8619 - protein, 30 aa, Artificial Sequence
  Description of Artificial Sequence: Synthetic polypeptide
GSAPSPAGESSRGTTIAGSPATSGSETPGT

SEQ ID NO: 8620 - protein, 30 aa, Artificial Sequence
  Description of Artificial Sequence: Synthetic polypeptide
GSAPEAGESAGATPAGLTGPATSGSETPGT

SEQ ID NO: 8621 - protein, 30 aa, Artificial Sequence
  Description of Artificial Sequence: Synthetic polypeptide
GSAPSASGAPLELEAGPGSPATSGSETPGT

SEQ ID NO: 8622 - protein, 30 aa, Artificial Sequence
  Description of Artificial Sequence: Synthetic polypeptide
GSAPSASGEPPELGAGPGSPATSGSETPGT

SEQ ID NO: 8623 - protein, 30 aa, Artificial Sequence
  Description of Artificial Sequence: Synthetic polypeptide
GSAPSASGEPSGLTEGPGSPATSGSETPGT

SEQ ID NO: 8624 - protein, 30 aa, Artificial Sequence
  Description of Artificial Sequence: Synthetic polypeptide
GSAPSASGTPAPLTEPPGSPATSGSETPGT

SEQ ID NO: 8625 - protein, 30 aa, Artificial Sequence
  Description of Artificial Sequence: Synthetic polypeptide
GSAPSASGTPAELTEPPGSPATSGSETPGT

SEQ ID NO: 8626 - protein, 30 aa, Artificial Sequence
  Description of Artificial Sequence: Synthetic polypeptide
GSAPSASGPPPGLTGPPGSPATSGSETPGT

SEQ ID NO: 8627 - protein, 30 aa, Artificial Sequence
  Description of Artificial Sequence: Synthetic polypeptide
GSAPSASGTPAPLGGEPGSPATSGSETPGT

SEQ ID NO: 8628 - protein, 30 aa, Artificial Sequence
  Description of Artificial Sequence: Synthetic polypeptide
GSAPSPAGAPEGLTGPAGSPATSGSETPGT

SEQ ID NO: 8629 - protein, 30 aa, Artificial Sequence
  Description of Artificial Sequence: Synthetic polypeptide
GSAPSPAGPPEGLETEAGSPATSGSETPGT

SEQ ID NO: 8630 - protein, 30 aa, Artificial Sequence
  Description of Artificial Sequence: Synthetic polypeptide
GSAPSPTSGQGGLTGPGSEPATSGSETPGT

SEQ ID NO: 8631 - protein, 30 aa, Artificial Sequence
  Description of Artificial Sequence: Synthetic polypeptide
GSAPSESAPPEGLETESTEPATSGSETPGT

SEQ ID NO: 8632 - protein, 30 aa, Artificial Sequence
  Description of Artificial Sequence: Synthetic polypeptide
GSAPSEGSEPLELGAASETPATSGSETPGT

SEQ ID NO: 8633 - protein, 30 aa, Artificial Sequence
  Description of Artificial Sequence: Synthetic polypeptide
GSAPSEGSGPAGLEAPSETPATSGSETPGT

SEQ ID NO: 8634 - protein, 30 aa, Artificial Sequence
  Description of Artificial Sequence: Synthetic polypeptide
GSAPSEPTPPASLEAEPGSPATSGSETPGT

SEQ ID NO: 8635 - protein, 29 aa, Artificial Sequence
  Description of Artificial Sequence: Synthetic peptide
GTAEAASASGGSAGGYAELRMGGAIPGSP

SEQ ID NO: 8636 - protein, 29 aa, Artificial Sequence
  Description of Artificial Sequence: Synthetic peptide
GTAEAASASGGTGGGYAPLRMGGGAPGSP

SEQ ID NO: 8637 - protein, 29 aa, Artificial Sequence
  Description of Artificial Sequence: Synthetic peptide
GTAEAASASGGAEGGYAALRMGGEIPGSP

SEQ ID NO: 8638 - protein, 29 aa, Artificial Sequence
  Description of Artificial Sequence: Synthetic peptide
GTAEAASASGGGPGGYALLRMGGPAPGSP

SEQ ID NO: 8639 - protein, 29 aa, Artificial Sequence
  Description of Artificial Sequence: Synthetic peptide
GTAEAASASGGEAGGYAFLRMGGSIPGSP

SEQ ID NO: 8640 - protein, 29 aa, Artificial Sequence
  Description of Artificial Sequence: Synthetic peptide
GTAEAASASGGPGGGYASLRMGGTAPGSP

SEQ ID NO: 8641 - protein, 29 aa, Artificial Sequence
  Description of Artificial Sequence: Synthetic peptide
GTAEAASASGGSEGGYATLRMGGAIPGSP

SEQ ID NO: 8642 - protein, 29 aa, Artificial Sequence
  Description of Artificial Sequence: Synthetic peptide
GTAEAASASGGTPGGYANLRMGGGAPGSP

SEQ ID NO: 8643 - protein, 29 aa, Artificial Sequence
  Description of Artificial Sequence: Synthetic peptide
GTAEAASASGGASGGYAHLRMGGEIPGSP

SEQ ID NO: 8644 - protein, 29 aa, Artificial Sequence
  Description of Artificial Sequence: Synthetic peptide
GTAEAASASGGGTGGYGELRMGGPAPGSP

SEQ ID NO: 8645 - protein, 29 aa, Artificial Sequence
  Description of Artificial Sequence: Synthetic peptide
GTAEAASASGGEAGGYPELRMGGSIPGSP

SEQ ID NO: 8646 - protein, 29 aa, Artificial Sequence
  Description of Artificial Sequence: Synthetic peptide
GTAEAASASGGPGGGYVELRMGGTAPGSP

SEQ ID NO: 8647 - protein, 29 aa, Artificial Sequence
  Description of Artificial Sequence: Synthetic peptide
GTAEAASASGGSEGGYLELRMGGAIPGSP

SEQ ID NO: 8648 - protein, 29 aa, Artificial Sequence
  Description of Artificial Sequence: Synthetic peptide
GTAEAASASGGTPGGYSELRMGGGAPGSP

SEQ ID NO: 8649 - protein, 29 aa, Artificial Sequence
  Description of Artificial Sequence: Synthetic peptide
GTAEAASASGGASGGYTELRMGGEIPGSP

SEQ ID NO: 8650 - protein, 29 aa, Artificial Sequence
  Description of Artificial Sequence: Synthetic peptide
GTAEAASASGGGTGGYQELRMGGPAPGSP

SEQ ID NO: 8651 - protein, 29 aa, Artificial Sequence
  Description of Artificial Sequence: Synthetic peptide
GTAEAASASGGEAGGYEELRMGGSIPGSP

SEQ ID NO: 8652 - protein, 29 aa, Artificial Sequence
  Description of Artificial Sequence: Synthetic peptide
GTAEAASASGGPGIGPAELRMGGTAPGSP

SEQ ID NO: 8653 - protein, 29 aa, Artificial Sequence
  Description of Artificial Sequence: Synthetic peptide
GTAEAASASGGSEIGAAELRMGGAIPGSP

SEQ ID NO: 8654 - protein, 29 aa, Artificial Sequence
  Description of Artificial Sequence: Synthetic peptide
GTAEAASASGGTPIGSAELRMGGGAPGSP

SEQ ID NO: 8655 - protein, 29 aa, Artificial Sequence
  Description of Artificial Sequence: Synthetic peptide
GTAEAASASGGASIGTAELRMGGEIPGSP

SEQ ID NO: 8656 - protein, 29 aa, Artificial Sequence
  Description of Artificial Sequence: Synthetic peptide
GTAEAASASGGGTIGNAELRMGGPAPGSP

SEQ ID NO: 8657 - protein, 29 aa, Artificial Sequence
  Description of Artificial Sequence: Synthetic peptide
GTAEAASASGGEAIGQAELRMGGSIPGSP

SEQ ID NO: 8658 - protein, 29 aa, Artificial Sequence
  Description of Artificial Sequence: Synthetic peptide
GTAEAASASGGPGGPYAELRMGGTAPGSP

SEQ ID NO: 8659 - protein, 29 aa, Artificial Sequence
  Description of Artificial Sequence: Synthetic peptide
GTAEAASASGGSEGAYAELRMGGAIPGSP

SEQ ID NO: 8660 - protein, 29 aa, Artificial Sequence
  Description of Artificial Sequence: Synthetic peptide
GTAEAASASGGTPGVYAELRMGGGAPGSP

SEQ ID NO: 8661 - protein, 29 aa, Artificial Sequence
  Description of Artificial Sequence: Synthetic peptide
GTAEAASASGGASGLYAELRMGGEIPGSP

SEQ ID NO: 8662 - protein, 29 aa, Artificial Sequence
  Description of Artificial Sequence: Synthetic peptide
GTAEAASASGGGTGIYAELRMGGPAPGSP

SEQ ID NO: 8663 - protein, 29 aa, Artificial Sequence
  Description of Artificial Sequence: Synthetic peptide
GTAEAASASGGEAGFYAELRMGGSIPGSP

SEQ ID NO: 8664 - protein, 29 aa, Artificial Sequence
  Description of Artificial Sequence: Synthetic peptide
GTAEAASASGGPGGYYAELRMGGTAPGSP

SEQ ID NO: 8665 - protein, 29 aa, Artificial Sequence
  Description of Artificial Sequence: Synthetic peptide
GTAEAASASGGSEGSYAELRMGGAIPGSP

SEQ ID NO: 8666 - protein, 29 aa, Artificial Sequence
  Description of Artificial Sequence: Synthetic peptide
GTAEAASASGGTPGNYAELRMGGGAPGSP

SEQ ID NO: 8667 - protein, 29 aa, Artificial Sequence
  Description of Artificial Sequence: Synthetic peptide
GTAEAASASGGASGEYAELRMGGEIPGSP

SEQ ID NO: 8668 - protein, 29 aa, Artificial Sequence
  Description of Artificial Sequence: Synthetic peptide
GTAEAASASGGGTGHYAELRMGGPAPGSP

SEQ ID NO: 8669 - protein, 29 aa, Artificial Sequence
  Description of Artificial Sequence: Synthetic peptide
GTAEAASASGGEAGGYAEARMGGSIPGSP

SEQ ID NO: 8670 - protein, 29 aa, Artificial Sequence
  Description of Artificial Sequence: Synthetic peptide
GTAEAASASGGPGGGYAEVRMGGTAPGSP

SEQ ID NO: 8671 - protein, 29 aa, Artificial Sequence
  Description of Artificial Sequence: Synthetic peptide
GTAEAASASGGSEGGYAEIRMGGAIPGSP

SEQ ID NO: 8672 - protein, 29 aa, Artificial Sequence
  Description of Artificial Sequence: Synthetic peptide
GTAEAASASGGTPGGYAEFRMGGGAPGSP

SEQ ID NO: 8673 - protein, 29 aa, Artificial Sequence
  Description of Artificial Sequence: Synthetic peptide
GTAEAASASGGASGGYAEYRMGGEIPGSP

SEQ ID NO: 8674 - protein, 29 aa, Artificial Sequence
  Description of Artificial Sequence: Synthetic peptide
GTAEAASASGGGTGGYAESRMGGPAPGSP

SEQ ID NO: 8675 - protein, 29 aa, Artificial Sequence
  Description of Artificial Sequence: Synthetic peptide
GTAEAASASGGEAGGYAETRMGGSIPGSP

SEQ ID NO: 8676 - protein, 29 aa, Artificial Sequence
  Description of Artificial Sequence: Synthetic peptide
GTAEAASASGGPGGGYAELAMGGTRPGSP

SEQ ID NO: 8677 - protein, 29 aa, Artificial Sequence
  Description of Artificial Sequence: Synthetic peptide
GTAEAASASGGSEGGYAELVMGGARPGSP

SEQ ID NO: 8678 - protein, 29 aa, Artificial Sequence
  Description of Artificial Sequence: Synthetic peptide
GTAEAASASGGTPGGYAELLMGGGRPGSP

SEQ ID NO: 8679 - protein, 29 aa, Artificial Sequence
  Description of Artificial Sequence: Synthetic peptide
GTAEAASASGGASGGYAELIMGGERPGSP

SEQ ID NO: 8680 - protein, 29 aa, Artificial Sequence
  Description of Artificial Sequence: Synthetic peptide
GTAEAASASGGGTGGYAELWMGGPRPGSP

SEQ ID NO: 8681 - protein, 29 aa, Artificial Sequence
  Description of Artificial Sequence: Synthetic peptide
GTAEAASASGGEAGGYAELSMGGSRPGSP

SEQ ID NO: 8682 - protein, 29 aa, Artificial Sequence
  Description of Artificial Sequence: Synthetic peptide
GTAEAASASGGPGGGYAELTMGGTRPGSP

SEQ ID NO: 8683 - protein, 29 aa, Artificial Sequence
  Description of Artificial Sequence: Synthetic peptide
GTAEAASASGGSEGGYAELQMGGARPGSP

SEQ ID NO: 8684 - protein, 29 aa, Artificial Sequence
  Description of Artificial Sequence: Synthetic peptide
GTAEAASASGGTPGGYAELNMGGGRPGSP

SEQ ID NO: 8685 - protein, 29 aa, Artificial Sequence
  Description of Artificial Sequence: Synthetic peptide
GTAEAASASGGASGGYAELEMGGERPGSP

SEQ ID NO: 8686 - protein, 29 aa, Artificial Sequence
  Description of Artificial Sequence: Synthetic peptide
GTAEAASASGGGTGGYAELRPGGPIPGSP

SEQ ID NO: 8687 - protein, 29 aa, Artificial Sequence
  Description of Artificial Sequence: Synthetic peptide
GTAEAASASGGEAGGYAELRAGGSAPGSP

SEQ ID NO: 8688 - protein, 29 aa, Artificial Sequence
  Description of Artificial Sequence: Synthetic peptide
GTAEAASASGGPGGGYAELRLGGTIPGSP

SEQ ID NO: 8689 - protein, 29 aa, Artificial Sequence
  Description of Artificial Sequence: Synthetic peptide
GTAEAASASGGSEGGYAELRIGGAAPGSP

SEQ ID NO: 8690 - protein, 29 aa, Artificial Sequence
  Description of Artificial Sequence: Synthetic peptide
GTAEAASASGGTPGGYAELRSGGGIPGSP

SEQ ID NO: 8691 - protein, 29 aa, Artificial Sequence
  Description of Artificial Sequence: Synthetic peptide
GTAEAASASGGASGGYAELRNGGEAPGSP

SEQ ID NO: 8692 - protein, 29 aa, Artificial Sequence
  Description of Artificial Sequence: Synthetic peptide
GTAEAASASGGGTGGYAELRQGGPIPGSP

SEQ ID NO: 8693 - protein, 29 aa, Artificial Sequence
  Description of Artificial Sequence: Synthetic peptide
GTAEAASASGGEAGGYAELRDGGSAPGSP

SEQ ID NO: 8694 - protein, 29 aa, Artificial Sequence
  Description of Artificial Sequence: Synthetic peptide
GTAEAASASGGPGGGYAELREGGTIPGSP

SEQ ID NO: 8695 - protein, 29 aa, Artificial Sequence
  Description of Artificial Sequence: Synthetic peptide
GTAEAASASGGSEGGYAELRHGGAAPGSP

SEQ ID NO: 8696 - protein, 29 aa, Artificial Sequence
  Description of Artificial Sequence: Synthetic peptide
GTAEAASASGGTPGGYAELRMPGGIPGSP

SEQ ID NO: 8697 - protein, 29 aa, Artificial Sequence
  Description of Artificial Sequence: Synthetic peptide
GTAEAASASGGASGGYAELRMAGEAPGSP

SEQ ID NO: 8698 - protein, 29 aa, Artificial Sequence
  Description of Artificial Sequence: Synthetic peptide
GTAEAASASGGGTGGYAELRMVGPIPGSP

SEQ ID NO: 8699 - protein, 29 aa, Artificial Sequence
  Description of Artificial Sequence: Synthetic peptide
GTAEAASASGGEAGGYAELRMLGSAPGSP

SEQ ID NO: 8700 - protein, 29 aa, Artificial Sequence
  Description of Artificial Sequence: Synthetic peptide
GTAEAASASGGPGGGYAELRMIGTIPGSP

SEQ ID NO: 8701 - protein, 29 aa, Artificial Sequence
  Description of Artificial Sequence: Synthetic peptide
GTAEAASASGGSEGGYAELRMYGAIPGSP

SEQ ID NO: 8702 - protein, 29 aa, Artificial Sequence
  Description of Artificial Sequence: Synthetic peptide
GTAEAASASGGTPGGYAELRMSGGAPGSP

SEQ ID NO: 8703 - protein, 29 aa, Artificial Sequence
  Description of Artificial Sequence: Synthetic peptide
GTAEAASASGGASGGYAELRMNGEIPGSP

SEQ ID NO: 8704 - protein, 29 aa, Artificial Sequence
  Description of Artificial Sequence: Synthetic peptide
GTAEAASASGGGTGGYAELRMQGPAPGSP

SEQ ID NO: 8705 - protein, 29 aa, Artificial Sequence
  Description of Artificial Sequence: Synthetic peptide
GTAEAASASGGANHTPAGLTGPGARPGSP

SEQ ID NO: 8706 - protein, 29 aa, Artificial Sequence
  Description of Artificial Sequence: Synthetic peptide
GTAEAASASGGANTAPEGLTGPSTRPGSP

SEQ ID NO: 8707 - protein, 29 aa, Artificial Sequence
  Description of Artificial Sequence: Synthetic peptide
GTAEAASASGGTGAPPGGLTGPGTRPGSP

SEQ ID NO: 8708 - protein, 29 aa, Artificial Sequence
  Description of Artificial Sequence: Synthetic peptide
GTAEAASASGGANHEPSGLTEGSPRPGSP

SEQ ID NO: 8709 - protein, 29 aa, Artificial Sequence
  Description of Artificial Sequence: Synthetic peptide
GTAEAASASGGANTEPPELGAGTERPGSP

SEQ ID NO: 8710 - protein, 29 aa, Artificial Sequence
  Description of Artificial Sequence: Synthetic peptide
GTAEAASASGGASGPPPGLTGPPGRPGSP

SEQ ID NO: 8711 - protein, 29 aa, Artificial Sequence
  Description of Artificial Sequence: Synthetic peptide
GTAEAASASGGASGTPAPLGGEPGRPGSP

SEQ ID NO: 8712 - protein, 29 aa, Artificial Sequence
  Description of Artificial Sequence: Synthetic peptide
GTAEAASASGGPAGPPEGLETEAGRPGSP

SEQ ID NO: 8713 - protein, 29 aa, Artificial Sequence
  Description of Artificial Sequence: Synthetic peptide
GTAEAASASGGPTSGQGGLTGPESRPGSP

SEQ ID NO: 8714 - protein, 29 aa, Artificial Sequence
  Description of Artificial Sequence: Synthetic peptide
GTAEAASASGGSAGGAANLVRGGAIPGSP

SEQ ID NO: 8715 - protein, 29 aa, Artificial Sequence
  Description of Artificial Sequence: Synthetic peptide
GTAEAASASGGTGGGAAPLVRGGGAPGSP

SEQ ID NO: 8716 - protein, 29 aa, Artificial Sequence
  Description of Artificial Sequence: Synthetic peptide
GTAEAASASGGAEGGAAALVRGGEIPGSP

SEQ ID NO: 8717 - protein, 29 aa, Artificial Sequence
  Description of Artificial Sequence: Synthetic peptide
GTAEAASASGGGPGGAALLVRGGPAPGSP

SEQ ID NO: 8718 - protein, 29 aa, Artificial Sequence
  Description of Artificial Sequence: Synthetic peptide
GTAEAASASGGEAGGAAFLVRGGSIPGSP

SEQ ID NO: 8719 - protein, 29 aa, Artificial Sequence
  Description of Artificial Sequence: Synthetic peptide
GTAEAASASGGPGGGAASLVRGGTAPGSP

SEQ ID NO: 8720 - protein, 29 aa, Artificial Sequence
  Description of Artificial Sequence: Synthetic peptide
GTAEAASASGGSEGGAATLVRGGAIPGSP

SEQ ID NO: 8721 - protein, 29 aa, Artificial Sequence
  Description of Artificial Sequence: Synthetic peptide
GTAEAASASGGTPGGAAGLVRGGGAPGSP

SEQ ID NO: 8722 - protein, 29 aa, Artificial Sequence
  Description of Artificial Sequence: Synthetic peptide
GTAEAASASGGASGGAADLVRGGEIPGSP

SEQ ID NO: 8723 - protein, 29 aa, Artificial Sequence
  Description of Artificial Sequence: Synthetic peptide
GTAEAASASGGGTGGAGNLVRGGPAPGSP

SEQ ID NO: 8724 - protein, 29 aa, Artificial Sequence
  Description of Artificial Sequence: Synthetic peptide
GTAEAASASGGEAGGAPNLVRGGSIPGSP

SEQ ID NO: 8725 - protein, 29 aa, Artificial Sequence
  Description of Artificial Sequence: Synthetic peptide
GTAEAASASGGPGGGAVNLVRGGTAPGSP

SEQ ID NO: 8726 - protein, 29 aa, Artificial Sequence
  Description of Artificial Sequence: Synthetic peptide
GTAEAASASGGSEGGALNLVRGGAIPGSP

SEQ ID NO: 8727 - protein, 29 aa, Artificial Sequence
  Description of Artificial Sequence: Synthetic peptide
GTAEAASASGGTPGGASNLVRGGGAPGSP

SEQ ID NO: 8728 - protein, 29 aa, Artificial Sequence
  Description of Artificial Sequence: Synthetic peptide
GTAEAASASGGASGGATNLVRGGEIPGSP

SEQ ID NO: 8729 - protein, 29 aa, Artificial Sequence
  Description of Artificial Sequence: Synthetic peptide
GTAEAASASGGGTGGAQNLVRGGPAPGSP

SEQ ID NO: 8730 - protein, 29 aa, Artificial Sequence
  Description of Artificial Sequence: Synthetic peptide
GTAEAASASGGEAGGAENLVRGGSIPGSP

SEQ ID NO: 8731 - protein, 30 aa, Artificial Sequence
  Description of Artificial Sequence: Synthetic polypeptide
GTAEAASASGEAGRSANHEPLGLVATPGSP

SEQ ID NO: 8732 - protein, 30 aa, Artificial Sequence
  Description of Artificial Sequence: Synthetic polypeptide
GTAEAASASGASGRSTNAGPSGLAGPPGSP

SEQ ID NO: 8733 - protein, 30 aa, Artificial Sequence
  Description of Artificial Sequence: Synthetic polypeptide
GTAEAASASGASGRSTNAGPQGLAGQPGSP

SEQ ID NO: 8734 - protein, 30 aa, Artificial Sequence
  Description of Artificial Sequence: Synthetic polypeptide
GTAEAASASGASGRSTNAGPPGLTGPPGSP

SEQ ID NO: 8735 - protein, 30 aa, Artificial Sequence
  Description of Artificial Sequence: Synthetic polypeptide
GTAEAASASGASSRGTNAGPAGLTGPPGSP

SEQ ID NO: 8736 - protein, 30 aa, Artificial Sequence
  Description of Artificial Sequence: Synthetic polypeptide
GTAEAASASGASSRTTNTGPSTLTGPPGSP

SEQ ID NO: 8737 - protein, 30 aa, Artificial Sequence
  Description of Artificial Sequence: Synthetic polypeptide
GTAEAASASGAAGRSDNGTPLELVAPPGSP

SEQ ID NO: 8738 - protein, 30 aa, Artificial Sequence
  Description of Artificial Sequence: Synthetic polypeptide
GTAEAASASGASGRGTNAGPAGLTGPPGSP

SEQ ID NO: 8739 - protein, 30 aa, Artificial Sequence
  Description of Artificial Sequence: Synthetic polypeptide
GTAEAASASGLFGRNDNHEPLELGGGPGSP

SEQ ID NO: 8740 - protein, 30 aa, Artificial Sequence
  Description of Artificial Sequence: Synthetic polypeptide
GTAEAASASGTAGRSDNLEPLGLVFGPGSP

SEQ ID NO: 8741 - protein, 30 aa, Artificial Sequence
  Description of Artificial Sequence: Synthetic polypeptide
GTAEAASASGLDGRSDNFHPPELVAGPGSP

SEQ ID NO: 8742 - protein, 30 aa, Artificial Sequence
  Description of Artificial Sequence: Synthetic polypeptide
GTAEAASASGLEGRSDNEEPENLVAGPGSP

SEQ ID NO: 8743 - protein, 30 aa, Artificial Sequence
  Description of Artificial Sequence: Synthetic polypeptide
GTAEAASASGLKGRSDNNAPLALVAGPGSP

SEQ ID NO: 8744 - protein, 30 aa, Artificial Sequence
  Description of Artificial Sequence: Synthetic polypeptide
GTAEAASASGVYSRGTNAGPHGLTGRPGSP

SEQ ID NO: 8745 - protein, 30 aa, Artificial Sequence
  Description of Artificial Sequence: Synthetic polypeptide
GTAEAASASGANSRGTNKGFAGLIGPPGSP

SEQ ID NO: 8746 - protein, 30 aa, Artificial Sequence
  Description of Artificial Sequence: Synthetic polypeptide
GTAEAASASGASSRLTNEAPAGLTIPPGSP

SEQ ID NO: 8747 - protein, 30 aa, Artificial Sequence
  Description of Artificial Sequence: Synthetic polypeptide
GTAEAASASGDQSRGTNAGPEGLTDPPGSP

SEQ ID NO: 8748 - protein, 30 aa, Artificial Sequence
  Description of Artificial Sequence: Synthetic polypeptide
GTAEAASASGESSRGTNIGQGGLTGPPGSP

SEQ ID NO: 8749 - protein, 30 aa, Artificial Sequence
  Description of Artificial Sequence: Synthetic polypeptide
GTAEAASASGSSSRGTNQDPAGLTIPPGSP

SEQ ID NO: 8750 - protein, 30 aa, Artificial Sequence
  Description of Artificial Sequence: Synthetic polypeptide
GTAEAASASGASSRGQNHSPMGLTGPPGSP

SEQ ID NO: 8751 - protein, 30 aa, Artificial Sequence
  Description of Artificial Sequence: Synthetic polypeptide
GTAEAASASGAYSRGPNAGPAGLEGRPGSP

SEQ ID NO: 8752 - protein, 30 aa, Artificial Sequence
  Description of Artificial Sequence: Synthetic polypeptide
GTAEAASASGASERGNNAGPANLTGFPGSP

SEQ ID NO: 8753 - protein, 30 aa, Artificial Sequence
  Description of Artificial Sequence: Synthetic polypeptide
GTAEAASASGASHRGTNPKPAILTGPPGSP

SEQ ID NO: 8754 - protein, 30 aa, Artificial Sequence
  Description of Artificial Sequence: Synthetic polypeptide
GTAEAASASGMSSRRTNANPAQLTGPPGSP

SEQ ID NO: 8755 - protein, 30 aa, Artificial Sequence
  Description of Artificial Sequence: Synthetic polypeptide
GTAEAASASGGAGRTDNHEPLELGAAPGSP

SEQ ID NO: 8756 - protein, 30 aa, Artificial Sequence
  Description of Artificial Sequence: Synthetic polypeptide
GTAEAASASGLAGRSENTAPLELTAGPGSP

SEQ ID NO: 8757 - protein, 30 aa, Artificial Sequence
  Description of Artificial Sequence: Synthetic polypeptide
GTAEAASASGLEGRPDNHEPLALVASPGSP

SEQ ID NO: 8758 - protein, 30 aa, Artificial Sequence
  Description of Artificial Sequence: Synthetic polypeptide
GTAEAASASGLSGRSDNEEPLALPAGPGSP

SEQ ID NO: 8759 - protein, 30 aa, Artificial Sequence
  Description of Artificial Sequence: Synthetic polypeptide
GTAEAASASGEAGRTDNHEPLELSAPPGSP

SEQ ID NO: 8760 - protein, 30 aa, Artificial Sequence
  Description of Artificial Sequence: Synthetic polypeptide
GTAEAASASGEGGRSDNHGPLELVSGPGSP

SEQ ID NO: 8761 - protein, 30 aa, Artificial Sequence
  Description of Artificial Sequence: Synthetic polypeptide
GTAEAASASGLSGRSDNEAPLELEAGPGSP

SEQ ID NO: 8762 - protein, 30 aa, Artificial Sequence
  Description of Artificial Sequence: Synthetic polypeptide
GTAEAASASGLGGRADNHEPPELGAGPGSP

SEQ ID NO: 8763 - protein, 30 aa, Artificial Sequence
  Description of Artificial Sequence: Synthetic polypeptide
GTAEAASASGPPSRGTNAEPAGLTGEPGSP

SEQ ID NO: 8764 - protein, 30 aa, Artificial Sequence
  Description of Artificial Sequence: Synthetic polypeptide
GTAEAASASGASTRGENAGPAGLEAPPGSP

SEQ ID NO: 8765 - protein, 30 aa, Artificial Sequence
  Description of Artificial Sequence: Synthetic polypeptide
GTAEAASASGESSRGTNGAPEGLTGPPGSP

SEQ ID NO: 8766 - protein, 30 aa, Artificial Sequence
  Description of Artificial Sequence: Synthetic polypeptide
GTAEAASASGASSRATNESPAGLTGEPGSP

SEQ ID NO: 8767 - protein, 30 aa, Artificial Sequence
  Description of Artificial Sequence: Synthetic polypeptide
GTAEAASASGASSRGENPPPGGLTGPPGSP

SEQ ID NO: 8768 - protein, 30 aa, Artificial Sequence
  Description of Artificial Sequence: Synthetic polypeptide
GTAEAASASGAASRGTNTGPAELTGSPGSP

SEQ ID NO: 8769 - protein, 30 aa, Artificial Sequence
  Description of Artificial Sequence: Synthetic polypeptide
GTAEAASASGAGSRTTNAGPGGLEGPPGSP

SEQ ID NO: 8770 - protein, 30 aa, Artificial Sequence
  Description of Artificial Sequence: Synthetic polypeptide
GTAEAASASGAPSRGENAGPATLTGAPGSP

SEQ ID NO: 8771 - protein, 30 aa, Artificial Sequence
  Description of Artificial Sequence: Synthetic polypeptide
GTAEAASASGESGRAANTGPPTLTAPPGSP

SEQ ID NO: 8772 - protein, 30 aa, Artificial Sequence
  Description of Artificial Sequence: Synthetic polypeptide
GTAEAASASGNPGRAANEGPPGLPGSPGSP

SEQ ID NO: 8773 - protein, 30 aa, Artificial Sequence
  Description of Artificial Sequence: Synthetic polypeptide
GTAEAASASGESSRAANLTPPELTGPPGSP

SEQ ID NO: 8774 - protein, 30 aa, Artificial Sequence
  Description of Artificial Sequence: Synthetic polypeptide
GTAEAASASGASGRAANETPPGLTGAPGSP

SEQ ID NO: 8775 - protein, 30 aa, Artificial Sequence
  Description of Artificial Sequence: Synthetic polypeptide
GTAEAASASGNSGRGENLGAPGLTGTPGSP

SEQ ID NO: 8776 - protein, 30 aa, Artificial Sequence
  Description of Artificial Sequence: Synthetic polypeptide
GTAEAASASGTTGRAANLTPAGLTGPPGSP

SEQ ID NO: 8777 - protein, 30 aa, Artificial Sequence
  Description of Artificial Sequence: Synthetic polypeptide
GTAEAASASGEAGRSANHTPAGLTGPPGSP

SEQ ID NO: 8778 - protein, 30 aa, Artificial Sequence
  Description of Artificial Sequence: Synthetic polypeptide
GTAEAASASGESGRAANTTPAGLTGPPGSP

SEQ ID NO: 8779 - protein, 33 aa, Artificial Sequence
  Description of Artificial Sequence: Synthetic polypeptide
GTAEAASASGTTGRATEAANLTPAGLTGPPGSP

SEQ ID NO: 8780 - protein, 33 aa, Artificial Sequence
  Description of Artificial Sequence: Synthetic polypeptide
GTAEAASASGTTGRAEEAANLTPAGLTGPPGSP

SEQ ID NO: 8781 - protein, 33 aa, Artificial Sequence
  Description of Artificial Sequence: Synthetic polypeptide
GTAEAASASGTTGRAGEAANLTPAGLTGPPGSP

SEQ ID NO: 8782 - protein, 33 aa, Artificial Sequence
  Description of Artificial Sequence: Synthetic polypeptide
GTAEAASASGTTGRATEAANATPAGLTGPPGSP

SEQ ID NO: 8783 - protein, 33 aa, Artificial Sequence
  Description of Artificial Sequence: Synthetic polypeptide
GTAEAASASGTTGRAGEAEGATSAGATGPPGSP

SEQ ID NO: 8784 - protein, 33 aa, Artificial Sequence
  Description of Artificial Sequence: Synthetic polypeptide
GTAEAASASGTTGEAGEAANATSAGATGPPGSP

SEQ ID NO: 8785 - protein, 33 aa, Artificial Sequence
  Description of Artificial Sequence: Synthetic polypeptide
GTAEAASASGTTGEAGEAAGLTPAGLTGPPGSP

SEQ ID NO: 8786 - protein, 33 aa, Artificial Sequence
  Description of Artificial Sequence: Synthetic polypeptide
GTAEAASASGTTGAAGEAANATPAGLTGPPGSP

SEQ ID NO: 8787 - protein, 33 aa, Artificial Sequence
  Description of Artificial Sequence: Synthetic polypeptide
GTAEAASASGTTGRAGEAAGLTPAGLTGPPGSP

SEQ ID NO: 8788 - protein, 33 aa, Artificial Sequence
  Description of Artificial Sequence: Synthetic polypeptide
GTAEAASASGTTGRAGEAANATSAGATGPPGSP

SEQ ID NO: 8789 - protein, 33 aa, Artificial Sequence
  Description of Artificial Sequence: Synthetic polypeptide
GTAEAASASGTTGEAGEAAGATSAGATGPPGSP

SEQ ID NO: 8790 - protein, 30 aa, Artificial Sequence
  Description of Artificial Sequence: Synthetic polypeptide
GTAEAASASGESGRAANTEPPELGAGPGSP

SEQ ID NO: 8791 - protein, 30 aa, Artificial Sequence
  Description of Artificial Sequence: Synthetic polypeptide
GTAEAASASGESGRAANTAPEGLTGPPGSP

SEQ ID NO: 8792 - protein, 30 aa, Artificial Sequence
  Description of Artificial Sequence: Synthetic polypeptide
GTAEAASASGEPGRAANHEPSGLTEGPGSP

SEQ ID NO: 8793 - protein, 33 aa, Artificial Sequence
  Description of Artificial Sequence: Synthetic polypeptide
GTAEAASASGESGRAANHTGAPPGGLTGPPGSP

SEQ ID NO: 8794 - protein, 33 aa, Artificial Sequence
  Description of Artificial Sequence: Synthetic polypeptide
GTAEAASASGTTGRTGEGANATPGGLTGPPGSP

SEQ ID NO: 8795 - protein, 33 aa, Artificial Sequence
  Description of Artificial Sequence: Synthetic polypeptide
GTAEAASASGRTGRSGEAANETPEGLEGPPGSP

SEQ ID NO: 8796 - protein, 33 aa, Artificial Sequence
  Description of Artificial Sequence: Synthetic polypeptide
GTAEAASASGRTGRTGESANETPAGLGGPPGSP

SEQ ID NO: 8797 - protein, 33 aa, Artificial Sequence
  Description of Artificial Sequence: Synthetic polypeptide
GTAEAASASGSTGRTGEPANETPAGLSGPPGSP

SEQ ID NO: 8798 - protein, 33 aa, Artificial Sequence
  Description of Artificial Sequence: Synthetic polypeptide
GTAEAASASGTTGRAGEPANATPTGLSGPPGSP

SEQ ID NO: 8799 - protein, 33 aa, Artificial Sequence
  Description of Artificial Sequence: Synthetic polypeptide
GTAEAASASGRTGRPGEGANATPTGLPGPPGSP

SEQ ID NO: 8800 - protein, 33 aa, Artificial Sequence
  Description of Artificial Sequence: Synthetic polypeptide
GTAEAASASGRTGRGGEAANATPSGLGGPPGSP

SEQ ID NO: 8801 - protein, 33 aa, Artificial Sequence
  Description of Artificial Sequence: Synthetic polypeptide
GTAEAASASGSTGRSGESANATPGGLGGPPGSP

SEQ ID NO: 8802 - protein, 33 aa, Artificial Sequence
  Description of Artificial Sequence: Synthetic polypeptide
GTAEAASASGRTGRTGEEANATPAGLPGPPGSP

SEQ ID NO: 8803 - protein, 33 aa, Artificial Sequence
  Description of Artificial Sequence: Synthetic polypeptide
GTAEAASASGATGRPGEPANTTPEGLEGPPGSP

SEQ ID NO: 8804 - protein, 33 aa, Artificial Sequence
  Description of Artificial Sequence: Synthetic polypeptide
GTAEAASASGSTGRSGEPANATPGGLTGPPGSP

SEQ ID NO: 8805 - protein, 33 aa, Artificial Sequence
  Description of Artificial Sequence: Synthetic polypeptide
GTAEAASASGPTGRGGEGANTTPTGLPGPPGSP

SEQ ID NO: 8806 - protein, 33 aa, Artificial Sequence
  Description of Artificial Sequence: Synthetic polypeptide
GTAEAASASGPTGRSGEGANATPSGLTGPPGSP

SEQ ID NO: 8807 - protein, 33 aa, Artificial Sequence
  Description of Artificial Sequence: Synthetic polypeptide
GTAEAASASGTTGRASEGANSTPAPLTEPPGSP

SEQ ID NO: 8808 - protein, 33 aa, Artificial Sequence
  Description of Artificial Sequence: Synthetic polypeptide
GTAEAASASGTYGRAAEAANTTPAGLTAPPGSP

SEQ ID NO: 8809 - protein, 33 aa, Artificial Sequence
  Description of Artificial Sequence: Synthetic polypeptide
GTAEAASASGTTGRATEGANATPAELTEPPGSP

SEQ ID NO: 8810 - protein, 33 aa, Artificial Sequence
  Description of Artificial Sequence: Synthetic polypeptide
GTAEAASASGTVGRASEEANTTPASLTGPPGSP

SEQ ID NO: 8811 - protein, 33 aa, Artificial Sequence
  Description of Artificial Sequence: Synthetic polypeptide
GTAEAASASGTTGRAPEAANATPAPLTGPPGSP

SEQ ID NO: 8812 - protein, 33 aa, Artificial Sequence
  Description of Artificial Sequence: Synthetic polypeptide
GTAEAASASGTWGRATEPANATPAPLTSPPGSP

SEQ ID NO: 8813 - protein, 33 aa, Artificial Sequence
  Description of Artificial Sequence: Synthetic polypeptide
GTAEAASASGTVGRASESANATPAELTSPPGSP

SEQ ID NO: 8814 - protein, 33 aa, Artificial Sequence
  Description of Artificial Sequence: Synthetic polypeptide
GTAEAASASGTVGRAPEGANSTPAGLTGPPGSP

SEQ ID NO: 8815 - protein, 33 aa, Artificial Sequence
  Description of Artificial Sequence: Synthetic polypeptide
GTAEAASASGTWGRATEAPNLEPATLTTPPGSP

SEQ ID NO: 8816 - protein, 33 aa, Artificial Sequence
  Description of Artificial Sequence: Synthetic polypeptide
GTAEAASASGTTGRATEAPNLTPAPLTEPPGSP

SEQ ID NO: 8817 - protein, 33 aa, Artificial Sequence
  Description of Artificial Sequence: Synthetic polypeptide
GTAEAASASGTQGRATEAPNLSPAALTSPPGSP

SEQ ID NO: 8818 - protein, 33 aa, Artificial Sequence
  Description of Artificial Sequence: Synthetic polypeptide
GTAEAASASGTQGRAAEAPNLTPATLTAPPGSP

SEQ ID NO: 8819 - protein, 33 aa, Artificial Sequence
  Description of Artificial Sequence: Synthetic polypeptide
GTAEAASASGTSGRAPEATNLAPAPLTGPPGSP

SEQ ID NO: 8820 - protein, 33 aa, Artificial Sequence
  Description of Artificial Sequence: Synthetic polypeptide
GTAEAASASGTQGRAAEAANLTPAGLTEPPGSP

SEQ ID NO: 8821 - protein, 33 aa, Artificial Sequence
  Description of Artificial Sequence: Synthetic polypeptide
GTAEAASASGTTGRAGSAPNLPPTGLTTPPGSP

SEQ ID NO: 8822 - protein, 33 aa, Artificial Sequence
  Description of Artificial Sequence: Synthetic polypeptide
GTAEAASASGTTGRAGGAENLPPEGLTAPPGSP

SEQ ID NO: 8823 - protein, 33 aa, Artificial Sequence
  Description of Artificial Sequence: Synthetic polypeptide
GTAEAASASGTTSRAGTATNLTPEGLTAPPGSP

SEQ ID NO: 8824 - protein, 33 aa, Artificial Sequence
  Description of Artificial Sequence: Synthetic polypeptide
GTAEAASASGTTGRAGTATNLPPSGLTTPPGSP

SEQ ID NO: 8825 - protein, 33 aa, Artificial Sequence
  Description of Artificial Sequence: Synthetic polypeptide
GTAEAASASGTTARAGEAENLSPSGLTAPPGSP

SEQ ID NO: 8826 - protein, 33 aa, Artificial Sequence
  Description of Artificial Sequence: Synthetic polypeptide
GTAEAASASGTTGRAGGAGNLAPGGLTEPPGSP

SEQ ID NO: 8827 - protein, 33 aa, Artificial Sequence
  Description of Artificial Sequence: Synthetic polypeptide
GTAEAASASGTTGRAGTATNLPPEGLTGPPGSP

SEQ ID NO: 8828 - protein, 33 aa, Artificial Sequence
  Description of Artificial Sequence: Synthetic polypeptide
GTAEAASASGTTGRAGGAANLAPTGLTEPPGSP

SEQ ID NO: 8829 - protein, 33 aa, Artificial Sequence
  Description of Artificial Sequence: Synthetic polypeptide
GTAEAASASGTTGRAGTAENLAPSGLTTPPGSP

SEQ ID NO: 8830 - protein, 33 aa, Artificial Sequence
  Description of Artificial Sequence: Synthetic polypeptide
GTAEAASASGTTGRAGSATNLGPGGLTGPPGSP

SEQ ID NO: 8831 - protein, 33 aa, Artificial Sequence
  Description of Artificial Sequence: Synthetic polypeptide
GTAEAASASGTTARAGGAENLTPAGLTEPPGSP

SEQ ID NO: 8832 - protein, 33 aa, Artificial Sequence
  Description of Artificial Sequence: Synthetic polypeptide
GTAEAASASGTTARAGSAENLSPSGLTGPPGSP

SEQ ID NO: 8833 - protein, 33 aa, Artificial Sequence
  Description of Artificial Sequence: Synthetic polypeptide
GTAEAASASGTTARAGGAGNLAPEGLTTPPGSP

SEQ ID NO: 8834 - protein, 33 aa, Artificial Sequence
  Description of Artificial Sequence: Synthetic polypeptide
GTAEAASASGTTSRAGAAENLTPTGLTGPPGSP

SEQ ID NO: 8835 - protein, 33 aa, Artificial Sequence
  Description of Artificial Sequence: Synthetic polypeptide
GTAEAASASGTYGRTTTPGNEPPASLEAEPGSP

SEQ ID NO: 8836 - protein, 33 aa, Artificial Sequence
  Description of Artificial Sequence: Synthetic polypeptide
GTAEAASASGTYSRGESGPNEPPPGLTGPPGSP

SEQ ID NO: 8837 - protein, 33 aa, Artificial Sequence
  Description of Artificial Sequence: Synthetic polypeptide
GTAEAASASGAWGRTGASENETPAPLGGEPGSP

SEQ ID NO: 8838 - protein, 33 aa, Artificial Sequence
  Description of Artificial Sequence: Synthetic polypeptide
GTAEAASASGRWGRAETTPNTPPEGLETEPGSP

SEQ ID NO: 8839 - protein, 33 aa, Artificial Sequence
  Description of Artificial Sequence: Synthetic polypeptide
GTAEAASASGESGRAANHTGAEPPELGAGPGSP

SEQ ID NO: 8840 - protein, 33 aa, Artificial Sequence
  Description of Artificial Sequence: Synthetic polypeptide
GTAEAASASGTTGRAGEAANLTPAGLTESPGSP

SEQ ID NO: 8841 - protein, 33 aa, Artificial Sequence
  Description of Artificial Sequence: Synthetic polypeptide
GTAEAASASGTTGRAGEAANLTPAALTESPGSP

SEQ ID NO: 8842 - protein, 33 aa, Artificial Sequence
  Description of Artificial Sequence: Synthetic polypeptide
GTAEAASASGTTGRAGEAANLTPAPLTESPGSP

SEQ ID NO: 8843 - protein, 33 aa, Artificial Sequence
  Description of Artificial Sequence: Synthetic polypeptide
GTAEAASASGTTGRAGEAANLTPEPLTESPGSP

SEQ ID NO: 8844 - protein, 33 aa, Artificial Sequence
  Description of Artificial Sequence: Synthetic polypeptide
GTAEAASASGTTGRAGEAANLTPAGLTGAPGSP

SEQ ID NO: 8845 - protein, 33 aa, Artificial Sequence
  Description of Artificial Sequence: Synthetic polypeptide
GTAEAASASGTTGRAGEAANLTPEGLTGAPGSP

SEQ ID NO: 8846 - protein, 33 aa, Artificial Sequence
  Description of Artificial Sequence: Synthetic polypeptide
GTAEAASASGTTGRAGEAANLTPEPLTGAPGSP

SEQ ID NO: 8847 - protein, 33 aa, Artificial Sequence
  Description of Artificial Sequence: Synthetic polypeptide
GTAEAASASGTTGRAGEAANLTPAGLTEAPGSP

SEQ ID NO: 8848 - protein, 33 aa, Artificial Sequence
  Description of Artificial Sequence: Synthetic polypeptide
GTAEAASASGTTGRAGEAANLTPEGLTEAPGSP

SEQ ID NO: 8849 - protein, 33 aa, Artificial Sequence
  Description of Artificial Sequence: Synthetic polypeptide
GTAEAASASGTTGRAGEAANLTPAPLTEAPGSP

SEQ ID NO: 8850 - protein, 33 aa, Artificial Sequence
  Description of Artificial Sequence: Synthetic polypeptide
GTAEAASASGTTGRAGEAANLTPEPLTEAPGSP

SEQ ID NO: 8851 - protein, 33 aa, Artificial Sequence
  Description of Artificial Sequence: Synthetic polypeptide
GTAEAASASGTTGRAGEAANLTPEPLTGPPGSP

SEQ ID NO: 8852 - protein, 33 aa, Artificial Sequence
  Description of Artificial Sequence: Synthetic polypeptide
GTAEAASASGTTGRAGEAANLTPAGLTGGPGSP

SEQ ID NO: 8853 - protein, 33 aa, Artificial Sequence
  Description of Artificial Sequence: Synthetic polypeptide
GTAEAASASGTTGRAGEAANLTPEGLTGGPGSP

SEQ ID NO: 8854 - protein, 33 aa, Artificial Sequence
  Description of Artificial Sequence: Synthetic polypeptide
GTAEAASASGTTGRAGEAANLTPEALTGGPGSP

SEQ ID NO: 8855 - protein, 33 aa, Artificial Sequence
  Description of Artificial Sequence: Synthetic polypeptide
GTAEAASASGTTGRAGEAANLTPEPLTGGPGSP

SEQ ID NO: 8856 - protein, 33 aa, Artificial Sequence
  Description of Artificial Sequence: Synthetic polypeptide
GTAEAASASGTTGRAGEAANLTPAGLTEGPGSP

SEQ ID NO: 8857 - protein, 33 aa, Artificial Sequence
  Description of Artificial Sequence: Synthetic polypeptide
GTAEAASASGTTGRAGEAANLTPEGLTEGPGSP

SEQ ID NO: 8858 - protein, 33 aa, Artificial Sequence
  Description of Artificial Sequence: Synthetic polypeptide
GTAEAASASGTTGRAGEAANLTPAPLTEGPGSP

SEQ ID NO: 8859 - protein, 33 aa, Artificial Sequence
  Description of Artificial Sequence: Synthetic polypeptide
GTAEAASASGTTGRAGEAANLTPEPLTEGPGSP

SEQ ID NO: 8860 - protein, 30 aa, Artificial Sequence
  Description of Artificial Sequence: Synthetic polypeptide
GTAEAASASGEAGRSAEATSAGATGPPGSP

SEQ ID NO: 8861 - protein, 30 aa, Artificial Sequence
  Description of Artificial Sequence: Synthetic polypeptide
GTAEAASASGSASGTYSRGESGPGSPPGSP

SEQ ID NO: 8862 - protein, 30 aa, Artificial Sequence
  Description of Artificial Sequence: Synthetic polypeptide
GTAEAASASGSASGEAGRTDTHPGSPPGSP

SEQ ID NO: 8863 - protein, 30 aa, Artificial Sequence
  Description of Artificial Sequence: Synthetic polypeptide
GTAEAASASGSASGEPGRAAEHPGSPPGSP

SEQ ID NO: 8864 - protein, 30 aa, Artificial Sequence
  Description of Artificial Sequence: Synthetic polypeptide
GTAEAASASGSPAGESSRGTTIAGSPPGSP

SEQ ID NO: 8865 - protein, 30 aa, Artificial Sequence
  Description of Artificial Sequence: Synthetic polypeptide
GTAEAASASGEAGESAGATPAGLTGPPGSP

SEQ ID NO: 8866 - protein, 30 aa, Artificial Sequence
  Description of Artificial Sequence: Synthetic polypeptide
GTAEAASASGSASGAPLELEAGPGSPPGSP

SEQ ID NO: 8867 - protein, 30 aa, Artificial Sequence
  Description of Artificial Sequence: Synthetic polypeptide
GTAEAASASGSASGEPPELGAGPGSPPGSP

SEQ ID NO: 8868 - protein, 30 aa, Artificial Sequence
  Description of Artificial Sequence: Synthetic polypeptide
GTAEAASASGSASGEPSGLTEGPGSPPGSP

SEQ ID NO: 8869 - protein, 30 aa, Artificial Sequence
  Description of Artificial Sequence: Synthetic polypeptide
GTAEAASASGSASGTPAPLTEPPGSPPGSP

SEQ ID NO: 8870 - protein, 30 aa, Artificial Sequence
  Description of Artificial Sequence: Synthetic polypeptide
GTAEAASASGSASGTPAELTEPPGSPPGSP

SEQ ID NO: 8871 - protein, 30 aa, Artificial Sequence
  Description of Artificial Sequence: Synthetic polypeptide
GTAEAASASGSASGPPPGLTGPPGSPPGSP

SEQ ID NO: 8872 - protein, 30 aa, Artificial Sequence
  Description of Artificial Sequence: Synthetic polypeptide
GTAEAASASGSASGTPAPLGGEPGSPPGSP

SEQ ID NO: 8873 - protein, 30 aa, Artificial Sequence
  Description of Artificial Sequence: Synthetic polypeptide
GTAEAASASGSPAGAPEGLTGPAGSPPGSP

SEQ ID NO: 8874 - protein, 30 aa, Artificial Sequence
  Description of Artificial Sequence: Synthetic polypeptide
GTAEAASASGSPAGPPEGLETEAGSPPGSP

SEQ ID NO: 8875 - protein, 30 aa, Artificial Sequence
  Description of Artificial Sequence: Synthetic polypeptide
GTAEAASASGSPTSGQGGLTGPGSEPPGSP

SEQ ID NO: 8876 - protein, 30 aa, Artificial Sequence
  Description of Artificial Sequence: Synthetic polypeptide
GTAEAASASGSESAPPEGLETESTEPPGSP

SEQ ID NO: 8877 - protein, 30 aa, Artificial Sequence
  Description of Artificial Sequence: Synthetic polypeptide
GTAEAASASGSEGSEPLELGAASETPPGSP

SEQ ID NO: 8878 - protein, 30 aa, Artificial Sequence
  Description of Artificial Sequence: Synthetic polypeptide
GTAEAASASGSEGSGPAGLEAPSETPPGSP

SEQ ID NO: 8879 - protein, 30 aa, Artificial Sequence
  Description of Artificial Sequence: Synthetic polypeptide
GTAEAASASGSEPTPPASLEAEPGSPPGSP

SEQ ID NO: 8880 - protein, 10 aa, Artificial Sequence
  Description of Artificial Sequence: Synthetic peptide
TPGTSTEPSE

SEQ ID NO: 8881 - protein, 14 aa, Artificial Sequence
  Description of Artificial Sequence: Synthetic peptide
GSAPGSEPATSGSE

SEQ ID NO: 8882 - protein, 864 aa, Artificial Sequence; identical to SEQ ID NO: 690
  Description of Artificial Sequence: Synthetic polypeptide

SEQ ID NO: 8883 - protein, 288 aa, Artificial Sequence; identical to SEQ ID NO: 686
  Description of Artificial Sequence: Synthetic polypeptide

SEQ ID NO: 8884 - protein, 5 aa, Artificial Sequence
  Description of Artificial Sequence: Synthetic peptide
SATPE

SEQ ID NO: 8885 - protein, 13 aa, Artificial Sequence
  Description of Artificial Sequence: Synthetic peptide
SGPGSEPATSGSE

SEQ ID NO: 8886 - protein, 12 aa, Artificial Sequence
  Description of Artificial Sequence: Synthetic peptide
GSAPGTSTEPSE

SEQ ID NO: 8887 - protein, 6 aa, Artificial Sequence
  Description of Artificial Sequence: Synthetic peptide
TPGTSE

SEQ ID NO: 8888 - protein, 11 aa, Artificial Sequence
  Description of Artificial Sequence: Synthetic peptide
SGPGTSTEPSE

SEQ ID NO: 8889 - protein, 8 aa, Artificial Sequence
  Description of Artificial Sequence: Synthetic peptide
GSAPGTSE

SEQ ID NO: 8890 - protein, 8 aa, Artificial Sequence
  Description of Artificial Sequence: Synthetic peptide
GTSTEPSE

SEQ ID NO: 8891 - protein, 16 aa, Artificial Sequence
  Description of Artificial Sequence: Synthetic peptide
GSAPGSPAGSPTSTEE

SEQ ID NO: 8892 - protein, 7 aa, Artificial Sequence
  Description of Artificial Sequence: Synthetic peptide
SGPGTSE

SEQ ID NO: 8893 - protein, 15 aa, Artificial Sequence
  Description of Artificial Sequence: Synthetic peptide
SGPGSPAGSPTSTEE

SEQ ID NO: 8894 - protein, 12 aa, Artificial Sequence
  Description of Artificial Sequence: Synthetic peptide
TPGSEPATSGSE

SEQ ID NO: 8895 - protein, 14 aa, Artificial Sequence
  Description of Artificial Sequence: Synthetic peptide
TPGSPAGSPTSTEE

SEQ ID NO: 8896 - protein, 292 aa, Artificial Sequence; identical to SEQ ID NO: 725
  Description of Artificial Sequence: Synthetic polypeptide

SEQ ID NO: 8897 - protein, 584 aa, Artificial Sequence; identical to SEQ ID NO: 732
  Description of Artificial Sequence: Synthetic polypeptide

SEQ ID NO: 8898 - protein, 23 aa, Artificial Sequence
  Description of Artificial Sequence: Synthetic peptide
MKKNIAFLLASMFVFSIATNAYA

SEQ ID NO: 8899 - protein, 13 aa, Artificial Sequence
  Description of Artificial Sequence: Synthetic peptide
SGPGSTPAESGSE

SEQ ID NO: 8900 - protein, 10 aa, Artificial Sequence
  Description of Artificial Sequence: Synthetic peptide
GYTFTRYTMH

SEQ ID NO: 8901 - protein, 17 aa, Artificial Sequence
  Description of Artificial Sequence: Synthetic peptide
YINPSRGYTNYNQKVKD

SEQ ID NO: 8902 - protein, 10 aa, Artificial Sequence
  Description of Artificial Sequence: Synthetic peptide
YYDDHYCLDY

SEQ ID NO: 8903 - protein, 10 aa, Artificial Sequence
  Description of Artificial Sequence: Synthetic peptide
GYTFTSYTMH

SEQ ID NO: 8904 - protein, 17 aa, Artificial Sequence
  Description of Artificial Sequence: Synthetic peptide
YINPSSGYTKYNQKFKD

SEQ ID NO: 8905 - protein, 10 aa, Artificial Sequence
  Description of Artificial Sequence: Synthetic peptide
WQDYDVYFDY

SEQ ID NO: 8906 - protein, 17 aa, Artificial Sequence
  Description of Artificial Sequence: Synthetic peptide
YINPSRGYTNYNQKFKD

SEQ ID NO: 8907 - protein, 17 aa, Artificial Sequence
  Description of Artificial Sequence: Synthetic peptide
YINPSRGYTNYADSVKG

SEQ ID NO: 8908 - protein, 10 aa, Artificial Sequence
  Description of Artificial Sequence: Synthetic peptide
SASSSVSYMN

SEQ ID NO: 8909 - protein, 7 aa, Artificial Sequence
  Description of Artificial Sequence: Synthetic peptide
DTSKLAS

SEQ ID NO: 8910 - protein, 9 aa, Artificial Sequence
  Description of Artificial Sequence: Synthetic peptide
QQWSSNPFT

SEQ ID NO: 8911 - protein, 10 aa, Artificial Sequence
  Description of Artificial Sequence: Synthetic peptide
RASSSVSYMH

SEQ ID NO: 8912 - protein, 7 aa, Artificial Sequence
  Description of Artificial Sequence: Synthetic peptide
ATSNLAS

SEQ ID NO: 8913 - protein, 9 aa, Artificial Sequence
  Description of Artificial Sequence: Synthetic peptide
QQWSSNPPT

SEQ ID NO: 8914 - protein, 10 aa, Artificial Sequence
  Description of Artificial Sequence: Synthetic peptide
RASSSVSYMN

SEQ ID NO: 8915 - protein, 7 aa, Artificial Sequence
  Description of Artificial Sequence: Synthetic peptide
DTSKVAS

SEQ ID NO: 8916 - protein, 9 aa, Artificial Sequence
  Description of Artificial Sequence: Synthetic peptide
QQWSSNPLT

SEQ ID NO: 8917 - protein, 10 aa, Artificial Sequence
  Description of Artificial Sequence: Synthetic peptide
RASQSVSYMN

SEQ ID NO: 8918 - protein, 5 aa, Artificial Sequence
  Description of Artificial Sequence: Synthetic peptide
DTYIH

SEQ ID NO: 8919 - protein, 17 aa, Artificial Sequence
  Description of Artificial Sequence: Synthetic peptide
RIDPANGYTKYDPKFQG

SEQ ID NO: 8920 - protein, 14 aa, Artificial Sequence
  Description of Artificial Sequence: Synthetic peptide
EGYYGNYGVYAMDY

SEQ ID NO: 8921 - protein, 10 aa, Artificial Sequence
  Description of Artificial Sequence: Synthetic peptide
GFTFSSYDIH

SEQ ID NO: 8922 - protein, 12 aa, Artificial Sequence
  Description of Artificial Sequence: Synthetic peptide
GPAGDTYYPGSV

SEQ ID NO: 8923 - protein, 13 aa, Artificial Sequence
  Description of Artificial Sequence: Synthetic peptide
GLITFGGLIAPFD

SEQ ID NO: 8924 - protein, 7 aa, Artificial Sequence
  Description of Artificial Sequence: Synthetic peptide
GFNIKDS

SEQ ID NO: 8925 - protein, 6 aa, Artificial Sequence
  Description of Artificial Sequence: Synthetic peptide
DPENGD

SEQ ID NO: 8926 - protein, 9 aa, Artificial Sequence
  Description of Artificial Sequence: Synthetic peptide
TPTGPYYFD

SEQ ID NO: 8927 - protein, 5 aa, Artificial Sequence
  Description of Artificial Sequence: Synthetic peptide
DTYMH

SEQ ID NO: 8928 - protein, 17 aa, Artificial Sequence
  Description of Artificial Sequence: Synthetic peptide
RIDPANGNSKYADSVKG

SEQ ID NO: 8929 - protein, 12 aa, Artificial Sequence
  Description of Artificial Sequence: Synthetic peptide
FGYYVSDYAMAY

SEQ ID NO: 8930 - protein, 4 aa, Artificial Sequence
  Description of Artificial Sequence: Synthetic peptide
DTYM

SEQ ID NO: 8931 - protein, 17 aa, Artificial Sequence
  Description of Artificial Sequence: Synthetic peptide
RIDPANGNSKYVPKFQG

SEQ ID NO: 8932 - protein, 5 aa, Artificial Sequence
  Description of Artificial Sequence: Synthetic peptide
TYWMS

SEQ ID NO: 8933 - protein, 17 aa, Artificial Sequence
  Description of Artificial Sequence: Synthetic peptide
EIHPDSSTINYAPSLKD

SEQ ID NO: 8934 - protein, 10 aa, Artificial Sequence
  Description of Artificial Sequence: Synthetic peptide
LYFGFPWFAY

SEQ ID NO: 8935 - protein, 10 aa, Artificial Sequence
  Description of Artificial Sequence: Synthetic peptide
GFTFTDYYMN

SEQ ID NO: 8936 - protein, 16 aa, Artificial Sequence
  Description of Artificial Sequence: Synthetic peptide
FIGNKANGYTTEYSAS

SEQ ID NO: 8937 - protein, 8 aa, Artificial Sequence
  Description of Artificial Sequence: Synthetic peptide
TYYCTRDR

SEQ ID NO: 8938 - protein, 5 aa, Artificial Sequence
  Description of Artificial Sequence: Synthetic peptide
SYWMH

SEQ ID NO: 8939 - protein, 19 aa, Artificial Sequence
  Description of Artificial Sequence: Synthetic peptide
FIRNKANGGTTEYAASVKG

SEQ ID NO: 8940 - protein, 10 aa, Artificial Sequence
  Description of Artificial Sequence: Synthetic peptide
DRGLRFYFDY

SEQ ID NO: 8941 - protein, 5 aa, Artificial Sequence
  Description of Artificial Sequence: Synthetic peptide
SYWMN

SEQ ID NO: 8942 - protein, 17 aa, Artificial Sequence
  Description of Artificial Sequence: Synthetic peptide
QIWPGDGDTNYNGKFKG

SEQ ID NO: 8943 - protein, 15 aa, Artificial Sequence
  Description of Artificial Sequence: Synthetic peptide
RETTTVGRYYYAMDY

SEQ ID NO: 8944 - protein, 5 aa, Artificial Sequence
  Description of Artificial Sequence: Synthetic peptide
DYAMH

SEQ ID NO: 8945 - protein, 17 aa, Artificial Sequence
  Description of Artificial Sequence: Synthetic peptide
TISWNSGSIGYADSVKG

SEQ ID NO: 8946 - protein, 13 aa, Artificial Sequence
  Description of Artificial Sequence: Synthetic peptide
DIQYGNYYYGMDV

SEQ ID NO: 8947 - protein, 5 aa, Artificial Sequence
  Description of Artificial Sequence: Synthetic peptide
SYNMH

SEQ ID NO: 8948 - protein, 17 aa, Artificial Sequence
  Description of Artificial Sequence: Synthetic peptide
AIYPGNGDTSYNQKFKG

SEQ ID NO: 8949 - protein, 13 aa, Artificial Sequence
  Description of Artificial Sequence: Synthetic peptide
VVYYSNSYWYFDV

SEQ ID NO: 8950 - protein, 5 aa, Artificial Sequence
  Description of Artificial Sequence: Synthetic peptide
YSWIN

SEQ ID NO: 8951 - protein, 17 aa, Artificial Sequence
  Description of Artificial Sequence: Synthetic peptide
RIFPGDGDTDYNGKFKG

SEQ ID NO: 8952 - protein, 10 aa, Artificial Sequence
  Description of Artificial Sequence: Synthetic peptide
NVFDGYWLVY

SEQ ID NO: 8953 - protein, 8 aa, Artificial Sequence
  Description of Artificial Sequence: Synthetic peptide
GYTFTSYN

SEQ ID NO: 8954 - protein, 8 aa, Artificial Sequence
  Description of Artificial Sequence: Synthetic peptide
IYPGNGDT

SEQ ID NO: 8955 - protein, 14 aa, Artificial Sequence
  Description of Artificial Sequence: Synthetic peptide
ARSTYYGGDWYFNV

SEQ ID NO: 8956 - protein, 15 aa, Artificial Sequence
  Description of Artificial Sequence: Synthetic peptide
AIYPGNGDTSYNQKF

SEQ ID NO: 8957 - protein, 10 aa, Artificial Sequence
  Description of Artificial Sequence: Synthetic peptide
GYTITDSNIH

SEQ ID NO: 8958 - protein, 17 aa, Artificial Sequence
  Description of Artificial Sequence: Synthetic peptide
YIYPYNGGTDYNQKFKN

SEQ ID NO: 8959 - protein, 7 aa, Artificial Sequence
  Description of Artificial Sequence: Synthetic peptide
GNPWLAY

SEQ ID NO: 8960 - protein, 8 aa, Artificial Sequence
  Description of Artificial Sequence: Synthetic peptide
GFTFNSFA

SEQ ID NO: 8961 - protein, 8 aa, Artificial Sequence
  Description of Artificial Sequence: Synthetic peptide
ISGSGGGT

SEQ ID NO: 8962 - protein, 15 aa, Artificial Sequence
  Description of Artificial Sequence: Synthetic peptide
AKDKILWFGEPVFDY

SEQ ID NO: 8963 - protein, 10 aa, Artificial Sequence
  Description of Artificial Sequence: Synthetic peptide
GYTFTNYGMN

SEQ ID NO: 8964 - protein, 17 aa, Artificial Sequence
  Description of Artificial Sequence: Synthetic peptide
WINTYTGEPTYADAFKG

SEQ ID NO: 8965 - protein, 9 aa, Artificial Sequence
  Description of Artificial Sequence: Synthetic peptide
DYGDYGMDY

SEQ ID NO: 8966 - protein, 10 aa, Artificial Sequence
  Description of Artificial Sequence: Synthetic peptide
GYTFSTYWIE

SEQ ID NO: 8967 - protein, 17 aa, Artificial Sequence
  Description of Artificial Sequence: Synthetic peptide
EILGPSGYTDYNEKFKA

SEQ ID NO: 8968 - protein, 9 aa, Artificial Sequence
  Description of Artificial Sequence: Synthetic peptide
WDRLYAMDY

SEQ ID NO: 8969 - protein, 5 aa, Artificial Sequence
  Description of Artificial Sequence: Synthetic peptide
SYIMH

SEQ ID NO: 8970 - protein, 17 aa, Artificial Sequence
  Description of Artificial Sequence: Synthetic peptide
VISYDGRNKYYADSVKG

SEQ ID NO: 8971 - protein, 9 aa, Artificial Sequence
  Description of Artificial Sequence: Synthetic peptide
DTDGYDFDY

SEQ ID NO: 8972 - protein, 5 aa, Artificial Sequence
  Description of Artificial Sequence: Synthetic peptide
YYAMH

SEQ ID NO: 8973 - protein, 17 aa, Artificial Sequence
  Description of Artificial Sequence: Synthetic peptide
VISYDGSIKYYADSVKG

SEQ ID NO: 8974 - protein, 10 aa, Artificial Sequence
  Description of Artificial Sequence: Synthetic peptide
EGPYSNYLDY

SEQ ID NO: 8975 - protein, 5 aa, Artificial Sequence
  Description of Artificial Sequence: Synthetic peptide
DYGMH

SEQ ID NO: 8976 - protein, 17 aa, Artificial Sequence
  Description of Artificial Sequence: Synthetic peptide
VIWYDGSNKYYADSVKG

SEQ ID NO: 8977 - protein, 9 aa, Artificial Sequence
  Description of Artificial Sequence: Synthetic peptide
DSIMVRGDY

SEQ ID NO: 8978 - protein, 5 aa, Artificial Sequence
  Description of Artificial Sequence: Synthetic peptide
DHGMH

SEQ ID NO: 8979 - protein, 7 aa, Artificial Sequence
  Description of Artificial Sequence: Synthetic peptide
SDYYYWS

SEQ ID NO: 8980 - protein, 16 aa, Artificial Sequence
  Description of Artificial Sequence: Synthetic peptide
YIYYSGSTNYNPSLKS

SEQ ID NO: 8981 - protein, 10 aa, Artificial Sequence
  Description of Artificial Sequence: Synthetic peptide
GDGDYGGNCF

SEQ ID NO: 8982 - protein, 5 aa, Artificial Sequence
  Description of Artificial Sequence: Synthetic peptide
SYGFS

SEQ ID NO: 8983 - protein, 17 aa, Artificial Sequence
  Description of Artificial Sequence: Synthetic peptide
WISASNGNTYYAQKLQG

SEQ ID NO: 8984 - protein, 8 aa, Artificial Sequence
  Description of Artificial Sequence: Synthetic peptide
VYADYADY

SEQ ID NO: 8985 - protein, 8 aa, Artificial Sequence
  Description of Artificial Sequence: Synthetic peptide
GYTFTDYY

SEQ ID NO: 8986 - protein, 9 aa, Artificial Sequence
  Description of Artificial Sequence: Synthetic peptide
VNPNRRGTT

SEQ ID NO: 8987 - protein, 8 aa, Artificial Sequence
  Description of Artificial Sequence: Synthetic peptide
ARANWLDY

SEQ ID NO: 8988 - protein, 5 aa, Artificial Sequence
  Description of Artificial Sequence: Synthetic peptide
SYWLH

SEQ ID NO: 8989 - protein, 17 aa, Artificial Sequence
  Description of Artificial Sequence: Synthetic peptide
MIDPSNSDTRFNPNFKD

SEQ ID NO: 8990 - protein, 12 aa, Artificial Sequence
  Description of Artificial Sequence: Synthetic peptide
ATYRSYVTPLDY

SEQ ID NO: 8991 - protein, 10 aa, Artificial Sequence
  Description of Artificial Sequence: Synthetic peptide
GFTFSSYGMH

SEQ ID NO: 8992 - protein, 15 aa, Artificial Sequence
  Description of Artificial Sequence: Synthetic peptide
VIWYDGSNKYYADSV

SEQ ID NO: 8993 - protein, 16 aa, Artificial Sequence
  Description of Artificial Sequence: Synthetic peptide
DPRGATLYYYYYGMDV

SEQ ID NO: 8994 - protein, 5 aa, Artificial Sequence
  Description of Artificial Sequence: Synthetic peptide
SYTMH

SEQ ID NO: 8995 - protein, 17 aa, Artificial Sequence
  Description of Artificial Sequence: Synthetic peptide
FISYDGNNKYYADSVKG

SEQ ID NO: 8996 - protein, 9 aa, Artificial Sequence
  Description of Artificial Sequence: Synthetic peptide
TGWLGPFDY

SEQ ID NO: 8997 - protein, 5 aa, Artificial Sequence
  Description of Artificial Sequence: Synthetic peptide
SGGYY

SEQ ID NO: 8998 - protein, 16 aa, Artificial Sequence
  Description of Artificial Sequence: Synthetic peptide
IIYYSGSTYYNPSLKS

SEQ ID NO: 8999 - protein, 13 aa, Artificial Sequence
  Description of Artificial Sequence: Synthetic peptide
VAIVTTIPGGMDV

SEQ ID NO: 9000 - protein, 5 aa, Artificial Sequence
  Description of Artificial Sequence: Synthetic peptide
NYWLG

SEQ ID NO: 9001 - protein, 17 aa, Artificial Sequence
  Description of Artificial Sequence: Synthetic peptide
DIFPGSGNIHYNEKFKG

SEQ ID NO: 9002 - protein, 10 aa, Artificial Sequence
  Description of Artificial Sequence: Synthetic peptide
LRNWDEPMDY

SEQ ID NO: 9003 - protein, 5 aa, Artificial Sequence
  Description of Artificial Sequence: Synthetic peptide
SYGMH

SEQ ID NO: 9004 - protein, 17 aa, Artificial Sequence
  Description of Artificial Sequence: Synthetic peptide
VISYDGSNKYYADSVKG

SEQ ID NO: 9005 - protein, 18 aa, Artificial Sequence
  Description of Artificial Sequence: Synthetic peptide
DMGWGSGWRPYYYYGMDV

SEQ ID NO: 9006 - protein, 8 aa, Artificial Sequence
  Description of Artificial Sequence: Synthetic peptide
GYAFTNYL

SEQ ID NO: 9007 - protein, 8 aa, Artificial Sequence
  Description of Artificial Sequence: Synthetic peptide
INPGSGGT

SEQ ID NO: 9008 - protein, 9 aa, Artificial Sequence
  Description of Artificial Sequence: Synthetic peptide
ARDGPWFAY

SEQ ID NO: 9009 - protein, 13 aa, Artificial Sequence
  Description of Artificial Sequence: Synthetic peptide
WINTYTGEPTYAD

SEQ ID NO: 9010 - protein, 5 aa, Artificial Sequence
  Description of Artificial Sequence: Synthetic peptide
SKGDY

SEQ ID NO: 9011 - protein, 10 aa, Artificial Sequence
  Description of Artificial Sequence: Synthetic peptide
GYTFTDHAIH

SEQ ID NO: 9012 - protein, 13 aa, Artificial Sequence
  Description of Artificial Sequence: Synthetic peptide
YFSPGNDDFKYNE

SEQ ID NO: 9013 - protein, 6 aa, Artificial Sequence
  Description of Artificial Sequence: Synthetic peptide
SLNMAY

SEQ ID NO: 9014 - protein, 13 aa, Artificial Sequence
  Description of Artificial Sequence: Synthetic peptide
WINTYTGEPTYGE

SEQ ID NO: 9015 - protein, 5 aa, Artificial Sequence
  Description of Artificial Sequence: Synthetic peptide
NYVDY

SEQ ID NO: 9016 - protein, 5 aa, Artificial Sequence
  Description of Artificial Sequence: Synthetic peptide
NYGMN

SEQ ID NO: 9017 - protein, 17 aa, Artificial Sequence
  Description of Artificial Sequence: Synthetic peptide
WINTYTGESTYADSFKG

SEQ ID NO: 9018 - protein, 6 aa, Artificial Sequence
  Description of Artificial Sequence: Synthetic peptide
FAIKGD

SEQ ID NO: 9019 - protein, 7 aa, Artificial Sequence
  Description of Artificial Sequence: Synthetic peptide
FAIKGDY

SEQ ID NO: 9020 - protein, 5 aa, Artificial Sequence
  Description of Artificial Sequence: Synthetic peptide
HYMMA

SEQ ID NO: 9021 - protein, 17 aa, Artificial Sequence
  Description of Artificial Sequence: Synthetic peptide
RIGPSGGPTHYADSVKG

SEQ ID NO: 9022 - protein, 15 aa, Artificial Sequence
  Description of Artificial Sequence: Synthetic peptide
YDYVAVAGPAEYFQH

SEQ ID NO: 9023 - protein, 8 aa, Artificial Sequence
  Description of Artificial Sequence: Synthetic peptide
GFTFSGYG

SEQ ID NO: 9024 - protein, 8 aa, Artificial Sequence
  Description of Artificial Sequence: Synthetic peptide
ISSGGSYT

SEQ ID NO: 9025 - protein, 10 aa, Artificial Sequence
  Description of Artificial Sequence: Synthetic peptide
ARHGDDPAWF

SEQ ID NO: 9026 - protein, 5 aa, Artificial Sequence
  Description of Artificial Sequence: Synthetic peptide
GYFMN

SEQ ID NO: 9027 - protein, 17 aa, Artificial Sequence
  Description of Artificial Sequence: Synthetic peptide
RIHPYDGDTFYNQKFQG

SEQ ID NO: 9028 - protein, 9 aa, Artificial Sequence
  Description of Artificial Sequence: Synthetic peptide
YDGSRAMDY

SEQ ID NO: 9029 - protein, 8 aa, Artificial Sequence
  Description of Artificial Sequence: Synthetic peptide
YDGSRAMD

SEQ ID NO: 9030 - protein, 17 aa, Artificial Sequence
  Description of Artificial Sequence: Synthetic peptide
RIFPYNGDTFYNQKFKG

SEQ ID NO: 9031 - protein, 7 aa, Artificial Sequence
  Description of Artificial Sequence: Synthetic peptide
GTHYFDY

SEQ ID NO: 9032 - protein, 5 aa, Artificial Sequence
  Description of Artificial Sequence: Synthetic peptide
DYEMH

SEQ ID NO: 9033 - protein, 17 aa, Artificial Sequence
  Description of Artificial Sequence: Synthetic peptide
ALDPKTGDTAYSQKFKG

SEQ ID NO: 9034 - protein, 6 aa, Artificial Sequence
  Description of Artificial Sequence: Synthetic peptide
FYSYTY

SEQ ID NO: 9035 - protein, 5 aa, Artificial Sequence
  Description of Artificial Sequence: Synthetic peptide
SYWIA

SEQ ID NO: 9036 - protein, 17 aa, Artificial Sequence
  Description of Artificial Sequence: Synthetic peptide
IIFPGDSDTRYSPSFQG

SEQ ID NO: 9037 - protein, 8 aa, Artificial Sequence
  Description of Artificial Sequence: Synthetic peptide
TREGYFDY

SEQ ID NO: 9038 - protein, 5 aa, Artificial Sequence
  Description of Artificial Sequence: Synthetic peptide
NYWIA

SEQ ID NO: 9039 - protein, 17 aa, Artificial Sequence
  Description of Artificial Sequence: Synthetic peptide
IIYPGDSDTRYSPSFQG

SEQ ID NO: 9040 - protein, 5 aa, Artificial Sequence
  Description of Artificial Sequence: Synthetic peptide
NYWIG

SEQ ID NO: 9041 - protein, 8 aa, Artificial Sequence
  Description of Artificial Sequence: Synthetic peptide
TREGFFDY

SEQ ID NO: 9042 - protein, 10 aa, Artificial Sequence
  Description of Artificial Sequence: Synthetic peptide
GFTFRNYGMH

SEQ ID NO: 9043 - protein, 19 aa, Artificial Sequence
  Description of Artificial Sequence: Synthetic peptide
VAVIWYDGSDKYYADSVRG

SEQ ID NO: 9044 - protein, 12 aa, Artificial Sequence
  Description of Artificial Sequence: Synthetic peptide
DILTGNPRDFDY

SEQ ID NO: 9045 - protein, 8 aa, Artificial Sequence
  Description of Artificial Sequence: Synthetic peptide
GFSLTNYG

SEQ ID NO: 9046 - protein, 7 aa, Artificial Sequence
  Description of Artificial Sequence: Synthetic peptide
IWSGGNT

SEQ ID NO: 9047 - protein, 13 aa, Artificial Sequence
  Description of Artificial Sequence: Synthetic peptide
ARALTYYDYEFAY

SEQ ID NO: 9048 - protein, 5 aa, Artificial Sequence
  Description of Artificial Sequence: Synthetic peptide
DYKIH

SEQ ID NO: 9049 - protein, 17 aa, Artificial Sequence
  Description of Artificial Sequence: Synthetic peptide
YFNPNSGYSTYAQKFQG

SEQ ID NO: 9050 - protein, 11 aa, Artificial Sequence
  Description of Artificial Sequence: Synthetic peptide
LSPGGYYVMDA

SEQ ID NO: 9051 - protein, 5 aa, Artificial Sequence
  Description of Artificial Sequence: Synthetic peptide
TYGMH

SEQ ID NO: 9052 - protein, 17 aa, Artificial Sequence
  Description of Artificial Sequence: Synthetic peptide
VIWDDGSYKYYGDSVKG

SEQ ID NO: 9053 - protein, 16 aa, Artificial Sequence
  Description of Artificial Sequence: Synthetic peptide
DGITMVRGVMKDYFDY

SEQ ID NO: 9054 - protein, 7 aa, Artificial Sequence
  Description of Artificial Sequence: Synthetic peptide
SGDYYWS

SEQ ID NO: 9055 - protein, 16 aa, Artificial Sequence
  Description of Artificial Sequence: Synthetic peptide
YIYYSGSTDYNPSLKS

SEQ ID NO: 9056 - protein, 11 aa, Artificial Sequence
  Description of Artificial Sequence: Synthetic peptide
VSIFGVGTFDY

SEQ ID NO: 9057 - protein, 5 aa, Artificial Sequence
  Description of Artificial Sequence: Synthetic peptide
SYAIS

SEQ ID NO: 9058 - protein, 17 aa, Artificial Sequence
  Description of Artificial Sequence: Synthetic peptide
SIIPIFGTVNYAQKFQG

SEQ ID NO: 9059 - protein, 12 aa, Artificial Sequence
  Description of Artificial Sequence: Synthetic peptide
DPSVNLYWYFDL

SEQ ID NO: 9060 - protein, 17 aa, Artificial Sequence
  Description of Artificial Sequence: Synthetic peptide
SIIPIFGAANPAQKSQG

SEQ ID NO: 9061 - protein, 10 aa, Artificial Sequence
  Description of Artificial Sequence: Synthetic peptide
MGRGKVAFDI

SEQ ID NO: 9062 - protein, 5 aa, Artificial Sequence
  Description of Artificial Sequence: Synthetic peptide
SYGIN

SEQ ID NO: 9063 - protein, 17 aa, Artificial Sequence
  Description of Artificial Sequence: Synthetic peptide
WISAYNGNTYYAQKLRG

SEQ ID NO: 9064 - protein, 14 aa, Artificial Sequence
  Description of Artificial Sequence: Synthetic peptide
DLGGYGSGSVPFDP

SEQ ID NO: 9065 - protein, 5 aa, Artificial Sequence
  Description of Artificial Sequence: Synthetic peptide
NYYIY

SEQ ID NO: 9066 - protein, 17 aa, Artificial Sequence
  Description of Artificial Sequence: Synthetic peptide
GINPTSGGSNFNEKFKT

SEQ ID NO: 9067 - protein, 14 aa, Artificial Sequence
  Description of Artificial Sequence: Synthetic peptide
QGLWFDSDGRGFDF

SEQ ID NO: 9068 - protein, 10 aa, Artificial Sequence
  Description of Artificial Sequence: Synthetic peptide
GGSVSSGDYY

SEQ ID NO: 9069 - protein, 7 aa, Artificial Sequence
  Description of Artificial Sequence: Synthetic peptide
IYYSGNT

SEQ ID NO: 9070 - protein, 11 aa, Artificial Sequence
  Description of Artificial Sequence: Synthetic peptide
VRDRVTGAFDI

SEQ ID NO: 9071 - protein, 8 aa, Artificial Sequence
  Description of Artificial Sequence: Synthetic peptide
GYTFTEYP

SEQ ID NO: 9072 - protein, 8 aa, Artificial Sequence
  Description of Artificial Sequence: Synthetic peptide
IYTDIGKP

SEQ ID NO: 9073 - protein, 11 aa, Artificial Sequence
  Description of Artificial Sequence: Synthetic peptide
VRDRYDSLFDY

SEQ ID NO: 9074 - protein, 5 aa, Artificial Sequence
  Description of Artificial Sequence: Synthetic peptide
HYDMS

SEQ ID NO: 9075 - protein, 17 aa, Artificial Sequence
  Description of Artificial Sequence: Synthetic peptide
YIASGGDITYYADTVKG

SEQ ID NO: 9076 - protein, 12 aa, Artificial Sequence
  Description of Artificial Sequence: Synthetic peptide
SSYGNNGDALDF

SEQ ID NO: 9077 - protein, 5 aa, Artificial Sequence
  Description of Artificial Sequence: Synthetic peptide
SYAMG

SEQ ID NO: 9078 - protein, 17 aa, Artificial Sequence
  Description of Artificial Sequence: Synthetic peptide
SISGSSRYIYYADSVKG

SEQ ID NO: 9079 - protein, 10 aa, Artificial Sequence
  Description of Artificial Sequence: Synthetic peptide
MDASGSYFNF

SEQ ID NO: 9080 - protein, 5 aa, Artificial Sequence
  Description of Artificial Sequence: Synthetic peptide
SYWIG

SEQ ID NO: 9081 - protein, 6 aa, Artificial Sequence
  Description of Artificial Sequence: Synthetic peptide
WRDSPL

SEQ ID NO: 9082 - protein, 8 aa, Artificial Sequence
  Description of Artificial Sequence: Synthetic peptide
GFNIKDTY

SEQ ID NO: 9083 - protein, 8 aa, Artificial Sequence
  Description of Artificial Sequence: Synthetic peptide
IYPTNGYT

SEQ ID NO: 9084 - protein, 13 aa, Artificial Sequence
  Description of Artificial Sequence: Synthetic peptide
SRWGGDGFYAMDY

SEQ ID NO: 9085 - protein, 5 aa, Artificial Sequence
  Description of Artificial Sequence: Synthetic peptide
SYAMS

SEQ ID NO: 9086 - protein, 17 aa, Artificial Sequence
  Description of Artificial Sequence: Synthetic peptide
AISGRGDNTYYADSVKG

SEQ ID NO: 9087 - protein, 12 aa, Artificial Sequence
  Description of Artificial Sequence: Synthetic peptide
AKMTSNAFAFDY

SEQ ID NO: 9088 - protein, 8 aa, Artificial Sequence
  Description of Artificial Sequence: Synthetic peptide
GFTFTDYT

SEQ ID NO: 9089 - protein, 8 aa, Artificial Sequence
  Description of Artificial Sequence: Synthetic peptide
VNPNSGGS

SEQ ID NO: 9090 - protein, 12 aa, Artificial Sequence
  Description of Artificial Sequence: Synthetic peptide
ARNLGPSFYFDY

SEQ ID NO: 9091 - protein, 5 aa, Artificial Sequence
  Description of Artificial Sequence: Synthetic peptide
HYVMA

SEQ ID NO: 9092 - protein, 17 aa, Artificial Sequence
  Description of Artificial Sequence: Synthetic peptide
SISSSGGWTLYADSVKG

SEQ ID NO: 9093 - protein, 10 aa, Artificial Sequence
  Description of Artificial Sequence: Synthetic peptide
GLKMATIFDY

SEQ ID NO: 9094 - protein, 5 aa, Artificial Sequence
  Description of Artificial Sequence: Synthetic peptide
GDWIH

SEQ ID NO: 9095 - protein, 17 aa, Artificial Sequence
  Description of Artificial Sequence: Synthetic peptide
EISAAGGYTDYADSVKG

SEQ ID NO: 9096 - protein, 12 aa, Artificial Sequence
  Description of Artificial Sequence: Synthetic peptide
ESRVSFEAAMDY

SEQ ID NO: 9097 - protein, 5 aa, Artificial Sequence
  Description of Artificial Sequence: Synthetic peptide
SYWMS

SEQ ID NO: 9098 - protein, 17 aa, Artificial Sequence
  Description of Artificial Sequence: Synthetic peptide
NINRDGSASYYVDSVKG

SEQ ID NO: 9099 - protein, 9 aa, Artificial Sequence
  Description of Artificial Sequence: Synthetic peptide
DRGVGYFDL

SEQ ID NO: 9100 - protein, 17 aa, Artificial Sequence
  Description of Artificial Sequence: Synthetic peptide
LIYPGDSDTKYSPSFQG

SEQ ID NO: 9101 - protein, 20 aa, Artificial Sequence
  Description of Artificial Sequence: Synthetic peptide
HDVGYCTDRTCAKWPEWLGV

SEQ ID NO: 9102 - protein, 5 aa, Artificial Sequence
  Description of Artificial Sequence: Synthetic peptide
DYYMY

SEQ ID NO: 9103 - protein, 17 aa, Artificial Sequence
  Description of Artificial Sequence: Synthetic peptide
YMSNVGAITDYPDTVKG

SEQ ID NO: 9104 - protein, 10 aa, Artificial Sequence
  Description of Artificial Sequence: Synthetic peptide
GTRDGSWFAY

SEQ ID NO: 9105 - protein, 8 aa, Artificial Sequence
  Description of Artificial Sequence: Synthetic peptide
GYSFTSYW

SEQ ID NO: 9106 - protein, 8 aa, Artificial Sequence
  Description of Artificial Sequence: Synthetic peptide
IDPGDSRT

SEQ ID NO: 9107 - protein, 13 aa, Artificial Sequence
  Description of Artificial Sequence: Synthetic peptide
ARGQLYGGTYMDG

SEQ ID NO: 9108 - protein, 5 aa, Artificial Sequence
  Description of Artificial Sequence: Synthetic peptide
IYGMH

SEQ ID NO: 9109 - protein, 17 aa, Artificial Sequence
  Description of Artificial Sequence: Synthetic peptide
VIWYDGSHEYYADSVKG

SEQ ID NO: 9110 - protein, 13 aa, Artificial Sequence
  Description of Artificial Sequence: Synthetic peptide
DGDYYDSGSPLDY

SEQ ID NO: 9111 - protein, 5 aa, Artificial Sequence
  Description of Artificial Sequence: Synthetic peptide
RIYGM

SEQ ID NO: 9112 - protein, 17 aa, Artificial Sequence
  Description of Artificial Sequence: Synthetic peptide
VLWYDGSHEYYADSVKG

SEQ ID NO: 9113 - protein, 5 aa, Artificial Sequence
  Description of Artificial Sequence: Synthetic peptide
RYWMS

SEQ ID NO: 9114 - protein, 17 aa, Artificial Sequence
  Description of Artificial Sequence: Synthetic peptide
SIKQAGSEKTYVDSVKG

SEQ ID NO: 9115 - protein, 22 aa, Artificial Sequence
  Description of Artificial Sequence: Synthetic peptide
EGAYYYDSASYYPYYYYYSMDV

SEQ ID NO: 9116 - protein, 5 aa, Artificial Sequence
  Description of Artificial Sequence: Synthetic peptide
GYTMN

SEQ ID NO: 9117 - protein, 17 aa, Artificial Sequence
  Description of Artificial Sequence: Synthetic peptide
LITPYNGASSYNQKFRG

SEQ ID NO: 9118 - protein, 10 aa, Artificial Sequence
  Description of Artificial Sequence: Synthetic peptide
GGYDGRGFDY

SEQ ID NO: 9119 - protein, 5 aa, Artificial Sequence
  Description of Artificial Sequence: Synthetic peptide
SYVLH

SEQ ID NO: 9120 - protein, 17 aa, Artificial Sequence
  Description of Artificial Sequence: Synthetic peptide
YINPYNDGTQYNEKFKG

SEQ ID NO: 9121 - protein, 10 aa, Artificial Sequence
  Description of Artificial Sequence: Synthetic peptide
GFGGSYGFAY

SEQ ID NO: 9122 - protein, 17 aa, Artificial Sequence
  Description of Artificial Sequence: Synthetic peptide
YINPYNDGTQTNKKFKG

SEQ ID NO: 9123 - protein, 17 aa, Artificial Sequence
  Description of Artificial Sequence: Synthetic peptide
YIYPGNGATNYNQKFQG

SEQ ID NO: 9124 - protein, 8 aa, Artificial Sequence
  Description of Artificial Sequence: Synthetic peptide
GDSVPFAY

SEQ ID NO: 9125 - protein, 5 aa, Artificial Sequence
  Description of Artificial Sequence: Synthetic peptide
AYWIE

SEQ ID NO: 9126 - protein, 17 aa, Artificial Sequence
  Description of Artificial Sequence: Synthetic peptide
EILPGSNNSRYNEKFKG

SEQ ID NO: 9127 - protein, 9 aa, Artificial Sequence
  Description of Artificial Sequence: Synthetic peptide
SYDFAWFAY

SEQ ID NO: 9128 - protein, 5 aa, Artificial Sequence
  Description of Artificial Sequence: Synthetic peptide
TYAIS

SEQ ID NO: 9129 - protein, 17 aa, Artificial Sequence
  Description of Artificial Sequence: Synthetic peptide
GIIPIFGKAHYAQKFQG

SEQ ID NO: 9130 - protein, 14 aa, Artificial Sequence
  Description of Artificial Sequence: Synthetic peptide
KFHFVSGSPFGMDV

SEQ ID NO: 9131 - protein, 8 aa, Artificial Sequence
  Description of Artificial Sequence: Synthetic peptide
GFTFSRYW

SEQ ID NO: 9132 - protein, 8 aa, Artificial Sequence
  Description of Artificial Sequence: Synthetic peptide
IKQDGSEK

SEQ ID NO: 9133 - protein, 14 aa, Artificial Sequence
  Description of Artificial Sequence: Synthetic peptide
AREGGWFGELAFDY

SEQ ID NO: 9134 - protein, 8 aa, Artificial Sequence
  Description of Artificial Sequence: Synthetic peptide
GFTFSDSW

SEQ ID NO: 9135 - protein, 8 aa, Artificial Sequence
  Description of Artificial Sequence: Synthetic peptide
ISPYGGST

SEQ ID NO: 9136 - protein, 11 aa, Artificial Sequence
  Description of Artificial Sequence: Synthetic peptide
ARRHWPGGFDY

SEQ ID NO: 9137 - protein, 8 aa, Artificial Sequence
  Description of Artificial Sequence: Synthetic peptide
GFTFSSYI

SEQ ID NO: 9138 - protein, 8 aa, Artificial Sequence
  Description of Artificial Sequence: Synthetic peptide
IYPSGGIT

SEQ ID NO: 9139 - protein, 13 aa, Artificial Sequence
  Description of Artificial Sequence: Synthetic peptide
ARIKLGTVTTVDY

SEQ ID NO: 9140 - protein, 10 aa, Artificial Sequence
  Description of Artificial Sequence: Synthetic peptide
GYTFTEYTIH

SEQ ID NO: 9141 - protein, 17 aa, Artificial Sequence
  Description of Artificial Sequence: Synthetic peptide
NINPNNGGTTYNQKFED

SEQ ID NO: 9142 - protein, 6 aa, Artificial Sequence
  Description of Artificial Sequence: Synthetic peptide
GWNFDY

SEQ ID NO: 9143 - protein, 8 aa, Artificial Sequence
  Description of Artificial Sequence: Synthetic peptide
GFTFSDYY

SEQ ID NO: 9144 - protein, 8 aa, Artificial Sequence
  Description of Artificial Sequence: Synthetic peptide
ISDGGYYT

SEQ ID NO: 9145 - protein, 14 aa, Artificial Sequence
  Description of Artificial Sequence: Synthetic peptide
ARGFPLLRHGAMDY

SEQ ID NO: 9146 - protein, 5 aa, Artificial Sequence
  Description of Artificial Sequence: Synthetic peptide
AYYMS

SEQ ID NO: 9147 - protein, 17 aa, Artificial Sequence
  Description of Artificial Sequence: Synthetic peptide
TIYPSSGKTYYATWVNG

SEQ ID NO: 9148 - protein, 12 aa, Artificial Sequence
  Description of Artificial Sequence: Synthetic peptide
DSYADDGALFNI

SEQ ID NO: 9149 - protein, 16 aa, Artificial Sequence
  Description of Artificial Sequence: Synthetic peptide
SISRGGTTYYPDSVKG

SEQ ID NO: 9150 - protein, 11 aa, Artificial Sequence
  Description of Artificial Sequence: Synthetic peptide
YDYDGYYAMDY

SEQ ID NO: 9151 - protein, 5 aa, Artificial Sequence
  Description of Artificial Sequence: Synthetic peptide
SHWMS

SEQ ID NO: 9152 - protein, 16 aa, Artificial Sequence
  Description of Artificial Sequence: Synthetic peptide
IIAASGSTYYANWAKG

SEQ ID NO: 9153 - protein, 12 aa, Artificial Sequence
  Description of Artificial Sequence: Synthetic peptide
DYGDYRLVTFNI

SEQ ID NO: 9154 - protein, 5 aa, Artificial Sequence
  Description of Artificial Sequence: Synthetic peptide
DYPIS

SEQ ID NO: 9155 - protein, 16 aa, Artificial Sequence
  Description of Artificial Sequence: Synthetic peptide
FINSGGSTWYASWVKG

SEQ ID NO: 9156 - protein, 11 aa, Artificial Sequence
  Description of Artificial Sequence: Synthetic peptide
GYSTYYCDFNI

SEQ ID NO: 9157 - protein, 5 aa, Artificial Sequence
  Description of Artificial Sequence: Synthetic peptide
DHAIH

SEQ ID NO: 9158 - protein, 17 aa, Artificial Sequence
  Description of Artificial Sequence: Synthetic peptide
YFSPGNDDFKYNERFKG

SEQ ID NO: 9159 - protein, 10 aa, Artificial Sequence
  Description of Artificial Sequence: Synthetic peptide
GYTFTNFGMN

SEQ ID NO: 9160 - protein, 17 aa, Artificial Sequence
  Description of Artificial Sequence: Synthetic peptide
WINTNTGEPRYAEEFKG

SEQ ID NO: 9161 - protein, 10 aa, Artificial Sequence
  Description of Artificial Sequence: Synthetic peptide
DWDGAYFFDY

SEQ ID NO: 9162 - protein, 10 aa, Artificial Sequence
  Description of Artificial Sequence: Synthetic peptide
GYTFTDYVIS

SEQ ID NO: 9163 - protein, 17 aa, Artificial Sequence
  Description of Artificial Sequence: Synthetic peptide
EIYPGSNSIYYNEKFKG

SEQ ID NO: 9164 - protein, 8 aa, Artificial Sequence
  Description of Artificial Sequence: Synthetic peptide
GGNYGFDY

SEQ ID NO: 9165 - protein, 19 aa, Artificial Sequence
  Description of Artificial Sequence: Synthetic peptide
RIRSKSNNYATYYADSVKD

SEQ ID NO: 9166 - protein, 11 aa, Artificial Sequence
  Description of Artificial Sequence: Synthetic peptide
QWDYDVRAMNY

SEQ ID NO: 9167 - protein, 17 aa, Artificial Sequence
  Description of Artificial Sequence: Synthetic peptide
WINTYTGEPTYTDDFKG

SEQ ID NO: 9168 - protein, 12 aa, Artificial Sequence
  Description of Artificial Sequence: Synthetic peptide
GGFGSSYWYFDV

SEQ ID NO: 9169 - protein, 11 aa, Artificial Sequence
  Description of Artificial Sequence: Synthetic peptide
GFAFSSYGMHW

SEQ ID NO: 9170 - protein, 17 aa, Artificial Sequence
  Description of Artificial Sequence: Synthetic peptide
VIWYDGSNKYYADSVRG

SEQ ID NO: 9171 - protein, 17 aa, Artificial Sequence
  Description of Artificial Sequence: Synthetic peptide
DHYGSGVHHYFYYGLDV

SEQ ID NO: 9172 - protein, 10 aa, Artificial Sequence
  Description of Artificial Sequence: Synthetic peptide
GFTFSSYSMN

SEQ ID NO: 9173 - protein, 17 aa, Artificial Sequence
  Description of Artificial Sequence: Synthetic peptide
SISSSSSYIYYADSVKG

SEQ ID NO: 9174 - protein, 7 aa, Artificial Sequence
  Description of Artificial Sequence: Synthetic peptide
VTDAFDI

SEQ ID NO: 9175 - protein, 8 aa, Artificial Sequence
  Description of Artificial Sequence: Synthetic peptide
GFTFSSYG

SEQ ID NO: 9176 - protein, 8 aa, Artificial Sequence
  Description of Artificial Sequence: Synthetic peptide
ITSGGSYT

SEQ ID NO: 9177 - protein, 10 aa, Artificial Sequence
  Description of Artificial Sequence: Synthetic peptide
VRIGEDALDY

SEQ ID NO: 9178 - protein, 11 aa, Artificial Sequence
  Description of Artificial Sequence: Synthetic peptide
KTSQDINKYMA

SEQ ID NO: 9179 - protein, 6 aa, Artificial Sequence
  Description of Artificial Sequence: Synthetic peptide
YTSALQ

SEQ ID NO: 9180 - protein, 8 aa, Artificial Sequence
  Description of Artificial Sequence: Synthetic peptide
LQYDNLWT

SEQ ID NO: 9181 - protein, 10 aa, Artificial Sequence
  Description of Artificial Sequence: Synthetic peptide
SQSVSSTYLA

SEQ ID NO: 9182 - protein, 7 aa, Artificial Sequence
  Description of Artificial Sequence: Synthetic peptide
GASSRAT

SEQ ID NO: 9183 - protein, 7 aa, Artificial Sequence
  Description of Artificial Sequence: Synthetic peptide
QHYDNSQ

SEQ ID NO: 9184 - protein, 5 aa, Artificial Sequence
  Description of Artificial Sequence: Synthetic peptide
SSSVS

SEQ ID NO: 9185 - protein, 3 aa, Artificial Sequence
  Description of Artificial Sequence: Synthetic peptide
LAS

SEQ ID NO: 9186 - protein, 6 aa, Artificial Sequence
  Description of Artificial Sequence: Synthetic peptide
RSSYPL

SEQ ID NO: 9187 - protein, 15 aa, Artificial Sequence
  Description of Artificial Sequence: Synthetic peptide
RAGESVDIFGVGFLH

SEQ ID NO: 9188 - protein, 7 aa, Artificial Sequence
  Description of Artificial Sequence: Synthetic peptide
RASNLES

SEQ ID NO: 9189 - protein, 9 aa, Artificial Sequence
  Description of Artificial Sequence: Synthetic peptide
QQTNEDPYT

SEQ ID NO: 9190 - protein, 11 aa, Artificial Sequence
  Description of Artificial Sequence: Synthetic peptide
KASQDVGTSVA

SEQ ID NO: 9191 - protein, 7 aa, Artificial Sequence
  Description of Artificial Sequence: Synthetic peptide
WTSTRHT

SEQ ID NO: 9192 - protein, 8 aa, Artificial Sequence
  Description of Artificial Sequence: Synthetic peptide
QQYSLYRS

SEQ ID NO: 9193 - protein, 11 aa, Artificial Sequence
  Description of Artificial Sequence: Synthetic peptide
RASSSVTYIHW

SEQ ID NO: 9194 - protein, 7 aa, Artificial Sequence
  Description of Artificial Sequence: Synthetic peptide
TSNLASG

SEQ ID NO: 9195 - protein, 9 aa, Artificial Sequence
  Description of Artificial Sequence: Synthetic peptide
QHWSSKPPT

SEQ ID NO: 9196 - protein, 14 aa, Artificial Sequence
  Description of Artificial Sequence: Synthetic peptide
TLRRGINVGAYSIY

SEQ ID NO: 9197 - protein, 11 aa, Artificial Sequence
  Description of Artificial Sequence: Synthetic peptide
YKSDSDKQQGS

SEQ ID NO: 9198 - protein, 10 aa, Artificial Sequence
  Description of Artificial Sequence: Synthetic peptide
MIWHSGASAV

SEQ ID NO: 9199 - protein, 13 aa, Artificial Sequence
  Description of Artificial Sequence: Synthetic peptide
KASQSVDYDGDSY

SEQ ID NO: 9200 - protein, 8 aa, Artificial Sequence
  Description of Artificial Sequence: Synthetic peptide
YDASNLVS

SEQ ID NO: 9201 - protein, 9 aa, Artificial Sequence
  Description of Artificial Sequence: Synthetic peptide
QQSTEDPWT

SEQ ID NO: 9202 - protein, 11 aa, Artificial Sequence
  Description of Artificial Sequence: Synthetic peptide
RASQSVSSYLA

SEQ ID NO: 9203 - protein, 7 aa, Artificial Sequence
  Description of Artificial Sequence: Synthetic peptide
DASNRAT

SEQ ID NO: 9204 - protein, 9 aa, Artificial Sequence
  Description of Artificial Sequence: Synthetic peptide
QQRSNWPIT

SEQ ID NO: 9205 - protein, 11 aa, Artificial Sequence
  Description of Artificial Sequence: Synthetic peptide
RASSSVSYMHW

SEQ ID NO: 9206 - protein, 7 aa, Artificial Sequence
  Description of Artificial Sequence: Synthetic peptide
APSNLAS

SEQ ID NO: 9207 - protein, 9 aa, Artificial Sequence
  Description of Artificial Sequence: Synthetic peptide
QQWSFNPPT

SEQ ID NO: 9208 - protein, 16 aa, Artificial Sequence
  Description of Artificial Sequence: Synthetic peptide
RSSKSLLHSNGITYLY

SEQ ID NO: 9209 - protein, 7 aa, Artificial Sequence
  Description of Artificial Sequence: Synthetic peptide
QMSNLVS

SEQ ID NO: 9210 - protein, 9 aa, Artificial Sequence
  Description of Artificial Sequence: Synthetic peptide
AQNLELPYT

SEQ ID NO: 9211 - protein, 5 aa, Artificial Sequence
  Description of Artificial Sequence: Synthetic peptide
SSVSY

SEQ ID NO: 9212 - protein, 3 aa, Artificial Sequence
  Description of Artificial Sequence: Synthetic peptide
ATS

SEQ ID NO: 9213 - protein, 9 aa, Artificial Sequence
  Description of Artificial Sequence: Synthetic peptide
QQWTSNPPT

SEQ ID NO: 9214 - protein, 15 aa, Artificial Sequence
  Description of Artificial Sequence: Synthetic peptide
RASESLDNYGIRFLT

SEQ ID NO: 9215 - protein, 7 aa, Artificial Sequence
  Description of Artificial Sequence: Synthetic peptide
AASNQGS

SEQ ID NO: 9216 - protein, 9 aa, Artificial Sequence
  Description of Artificial Sequence: Synthetic peptide
QQTKEVPWS

SEQ ID NO: 9217 - protein, 6 aa, Artificial Sequence
  Description of Artificial Sequence: Synthetic peptide
QSVSSY

SEQ ID NO: 9218 - protein, 3 aa, Artificial Sequence
  Description of Artificial Sequence: Synthetic peptide
DAS

SEQ ID NO: 9219 - protein, 9 aa, Artificial Sequence
  Description of Artificial Sequence: Synthetic peptide
QQRSNWPPT

SEQ ID NO: 9220 - protein, 15 aa, Artificial Sequence
  Description of Artificial Sequence: Synthetic peptide
RASKSVSTSGYSFMH

SEQ ID NO: 9221 - protein, 7 aa, Artificial Sequence
  Description of Artificial Sequence: Synthetic peptide
LASNLES

SEQ ID NO: 9222 - protein, 9 aa, Artificial Sequence
  Description of Artificial Sequence: Synthetic peptide
QHSREVPWT

SEQ ID NO: 9223 - protein, 7 aa, Artificial Sequence
  Description of Artificial Sequence: Synthetic peptide
LASDLPS

SEQ ID NO: 9224 - protein, 9 aa, Artificial Sequence
  Description of Artificial Sequence: Synthetic peptide
QHSREIPYT

SEQ ID NO: 9225 - protein, 7 aa, Artificial Sequence
  Description of Artificial Sequence: Synthetic peptide
YDASNRA

SEQ ID NO: 9226 - protein, 9 aa, Artificial Sequence
  Description of Artificial Sequence: Synthetic peptide
QQRTNWPLT

SEQ ID NO: 9227 - protein, 11 aa, Artificial Sequence
  Description of Artificial Sequence: Synthetic peptide
RASQGISSALA

SEQ ID NO: 9228 - protein, 7 aa, Artificial Sequence
  Description of Artificial Sequence: Synthetic peptide
DASSLES

SEQ ID NO: 9229 - protein, 9 aa, Artificial Sequence
  Description of Artificial Sequence: Synthetic peptide
QQFNSYPFT

SEQ ID NO: 9230 - protein, 11 aa, Artificial Sequence
  Description of Artificial Sequence: Synthetic peptide
RASQGISSWLA

SEQ ID NO: 9231 - protein, 7 aa, Artificial Sequence
  Description of Artificial Sequence: Synthetic peptide
AASSLQS

SEQ ID NO: 9232 - protein, 9 aa, Artificial Sequence
  Description of Artificial Sequence: Synthetic peptide
QQYNSYPLT

SEQ ID NO: 9233 - protein, 9 aa, Artificial Sequence
  Description of Artificial Sequence: Synthetic peptide
QQRSNWPLT

SEQ ID NO: 9234 - protein, 11 aa, Artificial Sequence
  Description of Artificial Sequence: Synthetic peptide
RASQGINTWLA

SEQ ID NO: 9235 - protein, 7 aa, Artificial Sequence
  Description of Artificial Sequence: Synthetic peptide
AASSLKS

SEQ ID NO: 9236 - protein, 9 aa, Artificial Sequence
  Description of Artificial Sequence: Synthetic peptide
QQANSFPLT

SEQ ID NO: 9237 - protein, 7 aa, Artificial Sequence
  Description of Artificial Sequence: Synthetic peptide
SSVSSIY

SEQ ID NO: 9238 - protein, 3 aa, Artificial Sequence
  Description of Artificial Sequence: Synthetic peptide
STS

SEQ ID NO: 9239 - protein, 9 aa, Artificial Sequence
  Description of Artificial Sequence: Synthetic peptide
QVYSGYPLT

SEQ ID NO: 9240 - protein, 17 aa, Artificial Sequence
  Description of Artificial Sequence: Synthetic peptide
KSSQSLLYTSSQKNYLA

SEQ ID NO: 9241 - protein, 7 aa, Artificial Sequence
  Description of Artificial Sequence: Synthetic peptide
WASTRES

SEQ ID NO: 9242 - protein, 9 aa, Artificial Sequence
  Description of Artificial Sequence: Synthetic peptide
QQYYAYPWT

SEQ ID NO: 9243 - protein, 11 aa, Artificial Sequence
  Description of Artificial Sequence: Synthetic peptide
RASQSINSYLD

SEQ ID NO: 9244 - protein, 9 aa, Artificial Sequence
  Description of Artificial Sequence: Synthetic peptide
QQYYSTPFT

SEQ ID NO: 9245 - protein, 12 aa, Artificial Sequence
  Description of Artificial Sequence: Synthetic peptide
RASQSVGSSYLA

SEQ ID NO: 9246 - protein, 7 aa, Artificial Sequence
  Description of Artificial Sequence: Synthetic peptide
GAFSRAT

SEQ ID NO: 9247 - protein, 9 aa, Artificial Sequence
  Description of Artificial Sequence: Synthetic peptide
QQYGSSPWT

SEQ ID NO: 9248 - protein, 11 aa, Artificial Sequence
  Description of Artificial Sequence: Synthetic peptide
RASQSIGISLH

SEQ ID NO: 9249 - protein, 7 aa, Artificial Sequence
  Description of Artificial Sequence: Synthetic peptide
YASQSFS

SEQ ID NO: 9250 - protein, 9 aa, Artificial Sequence
  Description of Artificial Sequence: Synthetic peptide
HQSRSFPWT

SEQ ID NO: 9251 - protein, 17 aa, Artificial Sequence
  Description of Artificial Sequence: Synthetic peptide
KSSQSLLNSGNQKNYLT

SEQ ID NO: 9252 - protein, 9 aa, Artificial Sequence
  Description of Artificial Sequence: Synthetic peptide
QNDYSYPLT

SEQ ID NO: 9253 - protein, 11 aa, Artificial Sequence
  Description of Artificial Sequence: Synthetic peptide
RTSQSISSYLN

SEQ ID NO: 9254 - protein, 9 aa, Artificial Sequence
  Description of Artificial Sequence: Synthetic peptide
QQSYDIPYT

SEQ ID NO: 9255 - protein, 6 aa, Artificial Sequence
  Description of Artificial Sequence: Synthetic peptide
ENVVTY

SEQ ID NO: 9256 - protein, 3 aa, Artificial Sequence
  Description of Artificial Sequence: Synthetic peptide
GAS

SEQ ID NO: 9257 - protein, 9 aa, Artificial Sequence
  Description of Artificial Sequence: Synthetic peptide
GQGYSYPYT

SEQ ID NO: 9258 - protein, 7 aa, Artificial Sequence
  Description of Artificial Sequence: Synthetic peptide
SASSSVS

SEQ ID NO: 9259 - protein, 7 aa, Artificial Sequence
  Description of Artificial Sequence: Synthetic peptide
DTSNLAS

SEQ ID NO: 9260 - protein, 9 aa, Artificial Sequence
  Description of Artificial Sequence: Synthetic peptide
HQRSGYPYT

SEQ ID NO: 9261 - protein, 17 aa, Artificial Sequence
  Description of Artificial Sequence: Synthetic peptide
KSSQSVLYSSNNKNYLA

SEQ ID NO: 9262 - protein, 9 aa, Artificial Sequence
  Description of Artificial Sequence: Synthetic peptide
QQYYSYPLT

SEQ ID NO: 9263 - protein, 14 aa, Artificial Sequence
  Description of Artificial Sequence: Synthetic peptide
RSSINKKGSNGITY

SEQ ID NO: 9264 - protein, 5 aa, Artificial Sequence
  Description of Artificial Sequence: Synthetic peptide
SGSGS

SEQ ID NO: 9265 - protein, 9 aa, Artificial Sequence
  Description of Artificial Sequence: Synthetic peptide
AQNLEIPRT

SEQ ID NO: 9266 - protein, 16 aa, Artificial Sequence
  Description of Artificial Sequence: Synthetic peptide
RSTKSLLHSNGITYLY

SEQ ID NO: 9267 - protein, 7 aa, Artificial Sequence
  Description of Artificial Sequence: Synthetic peptide
QMSNLAS

SEQ ID NO: 9268 - protein, 11 aa, Artificial Sequence
  Description of Artificial Sequence: Synthetic peptide
RASQSISTWLA

SEQ ID NO: 9269 - protein, 7 aa, Artificial Sequence
  Description of Artificial Sequence: Synthetic peptide
KASNLHT

SEQ ID NO: 9270 - protein, 9 aa, Artificial Sequence
  Description of Artificial Sequence: Synthetic peptide
QQYNSYSRT

SEQ ID NO: 9271 - protein, 7 aa, Artificial Sequence
  Description of Artificial Sequence: Synthetic peptide
SSISSNN

SEQ ID NO: 9272 - protein, 3 aa, Artificial Sequence
  Description of Artificial Sequence: Synthetic peptide
GTS

SEQ ID NO: 9273 - protein, 11 aa, Artificial Sequence
  Description of Artificial Sequence: Synthetic peptide
QQWSSYPYMYT

SEQ ID NO: 9274 - protein, 15 aa, Artificial Sequence
  Description of Artificial Sequence: Synthetic peptide
KASQSVSFAGTSLMH

SEQ ID NO: 9275 - protein, 7 aa, Artificial Sequence
  Description of Artificial Sequence: Synthetic peptide
RASNLEA

SEQ ID NO: 9276 - protein, 9 aa, Artificial Sequence
  Description of Artificial Sequence: Synthetic peptide
QQSREYPYT

SEQ ID NO: 9277 - protein, 11 aa, Artificial Sequence
  Description of Artificial Sequence: Synthetic peptide
RTSENIFSYLA

SEQ ID NO: 9278 - protein, 7 aa, Artificial Sequence
  Description of Artificial Sequence: Synthetic peptide
NAKTLAE

SEQ ID NO: 9279 - protein, 9 aa, Artificial Sequence
  Description of Artificial Sequence: Synthetic peptide
QHHYAFPWT

SEQ ID NO: 9280 - protein, 16 aa, Artificial Sequence
  Description of Artificial Sequence: Synthetic peptide
RSSQSLVHSNGNTYLH

SEQ ID NO: 9281 - protein, 7 aa, Artificial Sequence
  Description of Artificial Sequence: Synthetic peptide
KVSNRFS

SEQ ID NO: 9282 - protein, 9 aa, Artificial Sequence
  Description of Artificial Sequence: Synthetic peptide
SQNTHVPPT

SEQ ID NO: 9283 - protein, 12 aa, Artificial Sequence
  Description of Artificial Sequence: Synthetic peptide
RAVQSVSSSYLA

SEQ ID NO: 9284 - protein, 8 aa, Artificial Sequence
  Description of Artificial Sequence: Synthetic peptide
QQYGSSPT

SEQ ID NO: 9285 - protein, 12 aa, Artificial Sequence
  Description of Artificial Sequence: Synthetic peptide
RASQSVSSSYLA

SEQ ID NO: 9286 - protein, 16 aa, Artificial Sequence
  Description of Artificial Sequence: Synthetic peptide
RSSQSLVHSDGNTYLS

SEQ ID NO: 9287 - protein, 7 aa, Artificial Sequence
  Description of Artificial Sequence: Synthetic peptide
RISRRFS

SEQ ID NO: 9288 - protein, 9 aa, Artificial Sequence
  Description of Artificial Sequence: Synthetic peptide
MQSTHVPRT

SEQ ID NO: 9289 - protein, 6 aa, Artificial Sequence
  Description of Artificial Sequence: Synthetic peptide
QSIGTN

SEQ ID NO: 9290 - protein, 3 aa, Artificial Sequence
  Description of Artificial Sequence: Synthetic peptide
YAS

SEQ ID NO: 9291 - protein, 9 aa, Artificial Sequence
  Description of Artificial Sequence: Synthetic peptide
QQNNNWPTT

SEQ ID NO: 9292 - protein, 11 aa, Artificial Sequence
  Description of Artificial Sequence: Synthetic peptide
RASQGINNYLN

SEQ ID NO: 9293 - protein, 7 aa, Artificial Sequence
  Description of Artificial Sequence: Synthetic peptide
NTNNLQT

SEQ ID NO: 9294 - protein, 8 aa, Artificial Sequence
  Description of Artificial Sequence: Synthetic peptide
LQHNSFPT

SEQ ID NO: 9295 - protein, 11 aa, Artificial Sequence
  Description of Artificial Sequence: Synthetic peptide
RASQDISSALV

SEQ ID NO: 9296 - protein, 9 aa, Artificial Sequence
  Description of Artificial Sequence: Synthetic peptide
QQFNSYPLT

SEQ ID NO: 9297 - protein, 9 aa, Artificial Sequence
  Description of Artificial Sequence: Synthetic peptide
HQYGSTPLT

SEQ ID NO: 9298 - protein, 11 aa, Artificial Sequence
  Description of Artificial Sequence: Synthetic peptide
RASQSISSWWA

SEQ ID NO: 9299 - protein, 9 aa, Artificial Sequence
  Description of Artificial Sequence: Synthetic peptide
QQYHAHPTT

SEQ ID NO: 9300 - protein, 17 aa, Artificial Sequence
  Description of Artificial Sequence: Synthetic peptide
KSSQSVLYSPNNKNYLA

SEQ ID NO: 9301 - protein, 9 aa, Artificial Sequence
  Description of Artificial Sequence: Synthetic peptide
QQYYGSPIT

SEQ ID NO: 9302 - protein, 11 aa, Artificial Sequence
  Description of Artificial Sequence: Synthetic peptide
RASQSVSSNLA

SEQ ID NO: 9303 - protein, 7 aa, Artificial Sequence
  Description of Artificial Sequence: Synthetic peptide
GASTRAT

SEQ ID NO: 9304 - protein, 10 aa, Artificial Sequence
  Description of Artificial Sequence: Synthetic peptide
QDYRTWPRRV

SEQ ID NO: 9305 - protein, 16 aa, Artificial Sequence
  Description of Artificial Sequence: Synthetic peptide
RSSQNIVHSNGNTYLD

SEQ ID NO: 9306 - protein, 9 aa, Artificial Sequence
  Description of Artificial Sequence: Synthetic peptide
FQYSHVPWT

SEQ ID NO: 9307 - protein, 6 aa, Artificial Sequence
  Description of Artificial Sequence: Synthetic peptide
QDISNY

SEQ ID NO: 9308 - protein, 9 aa, Artificial Sequence
  Description of Artificial Sequence: Synthetic peptide
QHFDHLPLA

SEQ ID NO: 9309 - protein, 11 aa, Artificial Sequence
  Description of Artificial Sequence: Synthetic peptide
QSLVHSNGNTY

SEQ ID NO: 9310 - protein, 5 aa, Artificial Sequence
  Description of Artificial Sequence: Synthetic peptide
KVSNR

SEQ ID NO: 9311 - protein, 9 aa, Artificial Sequence
  Description of Artificial Sequence: Synthetic peptide
SQSTHVPWT

SEQ ID NO: 9312 - protein, 8 aa, Artificial Sequence
  Description of Artificial Sequence: Synthetic peptide
SQSTHVLT

SEQ ID NO: 9313 - protein, 11 aa, Artificial Sequence
  Description of Artificial Sequence: Synthetic peptide
RASPGIRNYLA

SEQ ID NO: 9314 - protein, 7 aa, Artificial Sequence
  Description of Artificial Sequence: Synthetic peptide
AASTLQS

SEQ ID NO: 9315 - protein, 9 aa, Artificial Sequence
  Description of Artificial Sequence: Synthetic peptide
QQYNSYPLS

SEQ ID NO: 9316 - protein, 14 aa, Artificial Sequence
  Description of Artificial Sequence: Synthetic peptide
GLSSGSVSTSYYPS

SEQ ID NO: 9317 - protein, 7 aa, Artificial Sequence
  Description of Artificial Sequence: Synthetic peptide
STNTRSS

SEQ ID NO: 9318 - protein, 10 aa, Artificial Sequence
  Description of Artificial Sequence: Synthetic peptide
VLYMGSGQYV

SEQ ID NO: 9319 - protein, 6 aa, Artificial Sequence
  Description of Artificial Sequence: Synthetic peptide
QDVNTA

SEQ ID NO: 9320 - protein, 3 aa, Artificial Sequence
  Description of Artificial Sequence: Synthetic peptide
SAS

SEQ ID NO: 9321 - protein, 9 aa, Artificial Sequence
  Description of Artificial Sequence: Synthetic peptide
QQHYTTPPT

SEQ ID NO: 9322 - protein, 14 aa, Artificial Sequence
  Description of Artificial Sequence: Synthetic peptide
TGSSSNIGAGYGVH

SEQ ID NO: 9323 - protein, 7 aa, Artificial Sequence
  Description of Artificial Sequence: Synthetic peptide
GNTNRPS

SEQ ID NO: 9324 - protein, 11 aa, Artificial Sequence
  Description of Artificial Sequence: Synthetic peptide
QFYDSSLSGWV

SEQ ID NO: 9325 - protein, 5 aa, Artificial Sequence
  Description of Artificial Sequence: Synthetic peptide
DVSIG

SEQ ID NO: 9326 - protein, 9 aa, Artificial Sequence
  Description of Artificial Sequence: Synthetic peptide
QQYYIYPYT

SEQ ID NO: 9327 - protein, 14 aa, Artificial Sequence
  Description of Artificial Sequence: Synthetic peptide
TGTSSDVGSYNVVS

SEQ ID NO: 9328 - protein, 7 aa, Artificial Sequence
  Description of Artificial Sequence: Synthetic peptide
EVSQRPS

SEQ ID NO: 9329 - protein, 11 aa, Artificial Sequence
  Description of Artificial Sequence: Synthetic peptide
CSYAGSSIFVI

SEQ ID NO: 9330 - protein, 11 aa, Artificial Sequence
  Description of Artificial Sequence: Synthetic peptide
RASQNIATDVA

SEQ ID NO: 9331 - protein, 7 aa, Artificial Sequence
  Description of Artificial Sequence: Synthetic peptide
SASFLYS

SEQ ID NO: 9332 - protein, 9 aa, Artificial Sequence
  Description of Artificial Sequence: Synthetic peptide
QQSEPEPYT

SEQ ID NO: 9333 - protein, 14 aa, Artificial Sequence
  Description of Artificial Sequence: Synthetic peptide
TGTSSDVGGYNFVS

SEQ ID NO: 9334 - protein, 7 aa, Artificial Sequence
  Description of Artificial Sequence: Synthetic peptide
DVSDRPS

SEQ ID NO: 9335 - protein, 11 aa, Artificial Sequence
  Description of Artificial Sequence: Synthetic peptide
SSYGSSSTHVI

SEQ ID NO: 9336 - protein, 13 aa, Artificial Sequence
  Description of Artificial Sequence: Synthetic peptide
SGSSSNIGNNYVS

SEQ ID NO: 9337 - protein, 7 aa, Artificial Sequence
  Description of Artificial Sequence: Synthetic peptide
DHTNRPA

SEQ ID NO: 9338 - protein, 11 aa, Artificial Sequence
  Description of Artificial Sequence: Synthetic peptide
ASWDYTLSGWV

SEQ ID NO: 9339 - protein, 16 aa, Artificial Sequence
  Description of Artificial Sequence: Synthetic peptide
RSSQRIVHSNGNTYLE

SEQ ID NO: 9340 - protein, 9 aa, Artificial Sequence
  Description of Artificial Sequence: Synthetic peptide
FQGSHVPFT

SEQ ID NO: 9341 - protein, 9 aa, Artificial Sequence
  Description of Artificial Sequence: Synthetic peptide
SSDIGGYNS

SEQ ID NO: 9342 - protein, 3 aa, Artificial Sequence
  Description of Artificial Sequence: Synthetic peptide
GVN

SEQ ID NO: 9343 - protein, 11 aa, Artificial Sequence
  Description of Artificial Sequence: Synthetic peptide
SSYDIESATPV

SEQ ID NO: 9344 - protein, 9 aa, Artificial Sequence
  Description of Artificial Sequence: Synthetic peptide
QQYGSSQYT

SEQ ID NO: 9345 - protein, 10 aa, Artificial Sequence
  Description of Artificial Sequence: Synthetic peptide
SASSSVSYMH

SEQ ID NO: 9346 - protein, 9 aa, Artificial Sequence
  Description of Artificial Sequence: Synthetic peptide
QQWSKHPLT

SEQ ID NO: 9347 - protein, 12 aa, Artificial Sequence
  Description of Artificial Sequence: Synthetic peptide
SASSSVSSSYLY

SEQ ID NO: 9348 - protein, 7 aa, Artificial Sequence
  Description of Artificial Sequence: Synthetic peptide
STSNLAS

SEQ ID NO: 9349 - protein, 9 aa, Artificial Sequence
  Description of Artificial Sequence: Synthetic peptide
HQWNRYPYT

SEQ ID NO: 9350 - protein, 10 aa, Artificial Sequence
  Description of Artificial Sequence: Synthetic peptide
SAHSSVSFMH

SEQ ID NO: 9351 - protein, 7 aa, Artificial Sequence
  Description of Artificial Sequence: Synthetic peptide
STSSLAS

SEQ ID NO: 9352 - protein, 9 aa, Artificial Sequence
  Description of Artificial Sequence: Synthetic peptide
QQRSSFPLT

SEQ ID NO: 9353 - protein, 17 aa, Artificial Sequence
  Description of Artificial Sequence: Synthetic peptide
KSSQSLLYSSNQKIYLA

SEQ ID NO: 9354 - protein, 6 aa, Artificial Sequence
  Description of Artificial Sequence: Synthetic peptide
ASTRES

SEQ ID NO: 9355 - protein, 9 aa, Artificial Sequence
  Description of Artificial Sequence: Synthetic peptide
QQYYRYPRT

SEQ ID NO: 9356 - protein, 8 aa, Artificial Sequence
  Description of Artificial Sequence: Synthetic peptide
QQRSNWPT

SEQ ID NO: 9357 - protein, 7 aa, Artificial Sequence
  Description of Artificial Sequence: Synthetic peptide
QRVSSSY

SEQ ID NO: 9358 - protein, 9 aa, Artificial Sequence
  Description of Artificial Sequence: Synthetic peptide
QQYGSLPWT

SEQ ID NO: 9359 - protein, 6 aa, Artificial Sequence
  Description of Artificial Sequence: Synthetic peptide
QDVSTA

SEQ ID NO: 9360 - protein, 9 aa, Artificial Sequence
  Description of Artificial Sequence: Synthetic peptide
QQYLYHPAT

SEQ ID NO: 9361 - protein, 9 aa, Artificial Sequence
  Description of Artificial Sequence: Synthetic peptide
SSDVGGYNY

SEQ ID NO: 9362 - protein, 3 aa, Artificial Sequence
  Description of Artificial Sequence: Synthetic peptide
DVS

SEQ ID NO: 9363 - protein, 10 aa, Artificial Sequence
  Description of Artificial Sequence: Synthetic peptide
SSYTSSSTRV

SEQ ID NO: 9364 - protein, 11 aa, Artificial Sequence
  Description of Artificial Sequence: Synthetic peptide
KASQDVGTAVD

SEQ ID NO: 9365 - protein, 7 aa, Artificial Sequence
  Description of Artificial Sequence: Synthetic peptide
WASTRHT

SEQ ID NO: 9366 - protein, 6 aa, Artificial Sequence
  Description of Artificial Sequence: Synthetic peptide
QNVDTN

SEQ ID NO: 9367 - protein, 9 aa, Artificial Sequence
  Description of Artificial Sequence: Synthetic peptide
QQYDSYPYT

SEQ ID NO: 9368 - protein, 12 aa, Artificial Sequence
  Description of Artificial Sequence: Synthetic peptide
TLSSAHKTDTID

SEQ ID NO: 9369 - protein, 7 aa, Artificial Sequence
  Description of Artificial Sequence: Synthetic peptide
GSYTKRP

SEQ ID NO: 9370 - protein, 9 aa, Artificial Sequence
  Description of Artificial Sequence: Synthetic peptide
GADYIGGYV

SEQ ID NO: 9371 - protein, 11 aa, Artificial Sequence
  Description of Artificial Sequence: Synthetic peptide
KASPDINSYLS

SEQ ID NO: 9372 - protein, 7 aa, Artificial Sequence
  Description of Artificial Sequence: Synthetic peptide
RANRLVD

SEQ ID NO: 9373 - protein, 9 aa, Artificial Sequence
  Description of Artificial Sequence: Synthetic peptide
LQYDEFPYT

SEQ ID NO: 9374 - protein, 11 aa, Artificial Sequence
  Description of Artificial Sequence: Synthetic peptide
QASQSIGSYLA

SEQ ID NO: 9375 - protein, 7 aa, Artificial Sequence
  Description of Artificial Sequence: Synthetic peptide
YASNLAS

SEQ ID NO: 9376 - protein, 10 aa, Artificial Sequence
  Description of Artificial Sequence: Synthetic peptide
LGSLSNSDNV

SEQ ID NO: 9377 - protein, 11 aa, Artificial Sequence
  Description of Artificial Sequence: Synthetic peptide
QASQSIDSNLA

SEQ ID NO: 9378 - protein, 7 aa, Artificial Sequence
  Description of Artificial Sequence: Synthetic peptide
RASNLAS

SEQ ID NO: 9379 - protein, 12 aa, Artificial Sequence
  Description of Artificial Sequence: Synthetic peptide
LGGVGNVSYRTS

SEQ ID NO: 9380 - protein, 14 aa, Artificial Sequence
  Description of Artificial Sequence: Synthetic peptide
QSLLYSGNQKNYLA

SEQ ID NO: 9381 - protein, 7 aa, Artificial Sequence
  Description of Artificial Sequence: Synthetic peptide
WASARES

SEQ ID NO: 9382 - protein, 11 aa, Artificial Sequence
  Description of Artificial Sequence: Synthetic peptide
KASQSVSNDVA

SEQ ID NO: 9383 - protein, 7 aa, Artificial Sequence
  Description of Artificial Sequence: Synthetic peptide
FATNRYT

SEQ ID NO: 9384 - protein, 9 aa, Artificial Sequence
  Description of Artificial Sequence: Synthetic peptide
QQDYSSPWT

SEQ ID NO: 9385 - protein, 12 aa, Artificial Sequence
  Description of Artificial Sequence: Synthetic peptide
TASSSVNSNYLH

SEQ ID NO: 9386 - protein, 9 aa, Artificial Sequence
  Description of Artificial Sequence: Synthetic peptide
HQYHRSPLT

SEQ ID NO: 9387 - protein, 11 aa, Artificial Sequence
  Description of Artificial Sequence: Synthetic peptide
KASQDVDTAVA

SEQ ID NO: 9388 - protein, 7 aa, Artificial Sequence
  Description of Artificial Sequence: Synthetic peptide
WASTRLT

SEQ ID NO: 9389 - protein, 9 aa, Artificial Sequence
  Description of Artificial Sequence: Synthetic peptide
QQYSSYPYT

SEQ ID NO: 9390 - protein, 12 aa, Artificial Sequence
  Description of Artificial Sequence: Synthetic peptide
KASQDVSIAVAW

SEQ ID NO: 9391 - protein, 7 aa, Artificial Sequence
  Description of Artificial Sequence: Synthetic peptide
SASYRYT

SEQ ID NO: 9392 - protein, 9 aa, Artificial Sequence
  Description of Artificial Sequence: Synthetic peptide
QQHYITPLT

SEQ ID NO: 9393 - protein, 9 aa, Artificial Sequence
  Description of Artificial Sequence: Synthetic peptide
QQYGSSPLT

SEQ ID NO: 9394 - protein, 8 aa, Artificial Sequence
  Description of Artificial Sequence: Synthetic peptide
RASQGIDN

SEQ ID NO: 9395 - protein, 7 aa, Artificial Sequence
  Description of Artificial Sequence: Synthetic peptide
DASNLDT

SEQ ID NO: 9396 - protein, 9 aa, Artificial Sequence
  Description of Artificial Sequence: Synthetic peptide
QQAKAFPPT

SEQ ID NO: 9397 - protein, 6 aa, Artificial Sequence
  Description of Artificial Sequence: Synthetic peptide
QDIAGS

SEQ ID NO: 9398 - protein, 9 aa, Artificial Sequence
  Description of Artificial Sequence: Synthetic peptide
LQYGSFPPT

SEQ ID NO: 9399 - protein, 29 aa, Unknown
  Description of Unknown: GLP native sequence motif
  MOD_RES (1)..(1): His, Val, or Tyr
  MOD_RES (2)..(2): Ala, Gly, Ile, Ser, Thr, or Val
  MOD_RES (3)..(3): Asp, Glu, His, or Gln
  MOD_RES (4)..(4): Ala or Gly
  MOD_RES (5)..(5): Ile, Leu, Met, Pro, Ser, Thr, or Val
  MOD_RES (6)..(6): Phe, Leu, or Tyr
  MOD_RES (7)..(7): Asp, Ile, Asn, Ser, or Thr
  MOD_RES (8)..(8): Ala, Asp, Glu, Lys, Asn, Ser, or Thr
  MOD_RES (9)..(9): Ala, Asp, Glu, Asn, Ser, Thr, or Val
  MOD_RES (10)..(10): Leu, Met, Val, or Tyr
  MOD_RES (11)..(11): Ala, Asn, Arg, Ser, Thr, or Tyr
  MOD_RES (12)..(12): Glu, His, Ile, Lys, Asn, Gln, Arg, Ser, or Thr
  MOD_RES (13)..(13): Ala, His, Ile, Leu, Met, Gln, Val, or Tyr
  MOD_RES (14)..(14): Leu, Met, Arg, or Thr
  MOD_RES (15)..(15): Ala, Asp, Glu, Gly, Lys, Gln, or Ser
  MOD_RES (16)..(16): Ala, Asp, Glu, Gly, Lys, Asn, Gln, Ser, or Tyr
  MOD_RES (17)..(17): Ala, Glu, Ile, Lys, Leu, Met, Gln, or Arg
  MOD_RES (18)..(18): Ala, Lys, Gln, Arg, Ser, Val, or Tyr
  MOD_RES (19)..(19): Ala, Ile, Leu, Met, Gln, Ser, Thr, or Val
  MOD_RES (20)..(20): Gly, Lys, Gln, or Arg
  MOD_RES (21)..(21): Asp, Glu, Lys, Leu, Gln, or Arg
  MOD_RES (22)..(22): Phe, His, Leu, Val, Trp, or Tyr
  MOD_RES (23)..(23): Ile, Leu, or Val
  MOD_RES (24)..(24): Ala, Asp, Glu, Gly, His, Ile, Lys, Asn, Gln, Arg, Ser, or Thr
  MOD_RES (25)..(25): Ala, Asp, Glu, Gly, Asn, Arg, Ser, Thr, or Trp
  MOD_RES (26)..(26): Gly, Ile, Leu, Val, or Trp
  MOD_RES (27)..(27): Ala, Ile, Lys, Leu, Met, Gln, Ser, or Val
  MOD_RES (28)..(28): Ala, Asp, Gly, Ile, Lys, Asn, Gln, Arg, Ser, or Thr
  MOD_RES (29)..(29): Gly, Lys, Arg, Ser, or Tyr
XXXXXXXXXXXXXXXXXXXXXXXXXXXXX

What is claimed is:

1. A method of detecting truncation of a fusion polypeptide in a sample, wherein the fusion polypeptide comprises at least one extended recombinant (XTEN) polypeptide fused to the N-terminus or the C-terminus of a biologically active polypeptide comprising a reference fragment, wherein the XTEN polypeptide is from 150 to 1,000 amino acids in length, comprises a plurality of non-overlapping sequence motifs each between 9 and 14 amino acids in length, and at least 90% of the amino acid residues of the XTEN polypeptide are glycine (G), alanine (A), serine (S), threonine (T), glutamate (E) or proline (P), wherein the XTEN comprises a barcode fragment, which is from 4 to 20 amino acids in length, occurs only once in the fusion polypeptide, and is located within 100 amino acids from the N-terminus of the XTEN polypeptide if the XTEN polypeptide is N-terminal to the biologically active polypeptide or from the C-terminus of the XTEN polypeptide if the XTEN polypeptide is C-terminal to the biologically active polypeptide, wherein the sample comprises a first set of polypeptides and a second set of polypeptides, wherein each polypeptide of the first set of polypeptides (a) has the same sequence as, or is truncated from, the fusion polypeptide and (b) retains the barcode fragment, and each polypeptide of the second set of polypeptides (a) is truncated from the fusion polypeptide and (b) lacks the barcode fragment, wherein each polypeptide of both the first set of polypeptides and the second set of polypeptides retains the reference fragment, the method comprising:

contacting the sample with a protease to produce a plurality of proteolytic fragments that result from cleavage of the first set of polypeptides and the second set of polypeptides, wherein the plurality of proteolytic fragments comprise:

a plurality of reference fragments; and a plurality of barcode fragments, and determining a ratio of the amount of barcode fragments to the amount of reference fragments, thereby assessing the relative amounts of the first set of polypeptides to the second set of polypeptides representing the truncation of the fusion polypeptide.

2. The method of claim 1, wherein the XTEN polypeptide has at least 90% sequence identity to a sequence selected from SEQ ID NOs: 8001-8019.

3. The method of claim 1, wherein the barcode fragment comprises a sequence having at least 90% sequence identity to one selected from SEQ ID NO: 8020-8030.

4. The method of claim 1, wherein the fusion polypeptide further comprises a second XTEN polypeptide on the other side of the biologically active polypeptide, wherein the second XTEN polypeptide is from 150 to 1,000 amino acids in length, comprises a plurality of non-overlapping sequence motifs each between 9 and 14 amino acids in length, and at least 90% of the amino acid residues of the second XTEN polypeptide are glycine (G), alanine (A), serine(S), threonine (T), glutamate (E) or proline (P), and wherein the second XTEN polypeptide comprises a second barcode fragment which is from 4 to 20 amino acids in length, occurs only once in the fusion polypeptide, and is located within 100 amino acids from the C-terminus of the second XTEN polypeptide if the second XTEN polypeptide is C-terminal to the biologically active polypeptide or from the N-terminus of the second XTEN polypeptide if the second XTEN polypeptide is N-terminal to the biologically active polypeptide.

5. The method of claim 4, wherein the second XTEN polypeptide has at least 90% sequence identity to a sequence selected from SEQ ID NOs: 8001-8019.

6. The method of claim 4, wherein the second barcode fragment comprises a sequence having at least 90% sequence identity to one selected from SEQ ID NO: 8020-8030.

7. The method of claim 1, wherein the protease is a Glu-C protease.

8. The method of claim 1, wherein the protease is not trypsin.

9. The method of claim 1, wherein determining a ratio of the amount of barcode fragments to the amount of reference fragments comprises quantifying barcode fragments and reference fragments from the sample after it has been contacted with the protease.

10. The method of claim 9, wherein the barcode fragments and the reference fragments are identified based on their respective masses.

11. The method of claim 1, wherein the barcode fragments and the reference fragments are identified via:

(i) mass spectrometry, and/or (ii) liquid chromatography-mass spectrometry (LC-MS).

12. The method of claim 1, wherein determining a ratio of the barcode fragments to the reference fragments comprises:

(i) isobaric labeling, and/or (ii) spiking the sample with one or both of an isotope labeled reference fragment and an isotope labeled barcode fragment.

* * * * *